United States Patent 11,364,309 (NEURONAL ENHANCERS) - sequence listing, part 2

SEQ ID NO: 1116 - DNA, 6623 bp, Homo sapiens
cttagtatttaataacatttggtcatacttatccatgtatagttccttccttattatcttttttttttttttttttgagaaagagtttcgctcttgttgcccaggctggagtacagtggcgtgatctcggcgcactgcaacttccacctcctgggttcaagcaattctcctgcctcagcctcccgagtagctgggattacaggcatctgccaccacgcccagctaattttttgtatttttagtagagacagggtttcaccatgttcaccaggctggtcttgaactcctgacctcaggtgatccactcatcttggcctcccaaagtgctgggattacaggcatgagccattgtgcccggactctgccttcttttctttcttcctttctttttctttggaaggggtcctataatattatattaaatccaatcacagacattgtcatttcacttaaaagattcccatatgtcttaaaaaaatatagaaaaattttgtatcacaatactgatattatatataacaaaattaccagtaattctttactgccatttaactcagtctacatttagatttcctcatttgtctcaagtgtctttttatagtggttggtttgttcaaatcaggattcaaatagtctatagcattagatttttttttcccataagtctcttaatctagaacagtcctcaccctcttgctgtttttcttccctgtaaaattgacttgttgacaaaaccaaatcagttgtccagcagaatgtcctatattctagaagttcctgcctactttctcatggtggtatttaacttattctatcctctgtatttcctgttagttggaatagcttgagatatttgcaaattattttggccattttttaaggaaatataaacattttacaaatttcatttcagccattcatttattcagcatttgagtgcctcctatgcaccaggcactgttctaggttctaggttcattgggctatgctttgttttcctagcaattcttttgttctagaggaactgcacacttgttttttaatttaggttttttcatccataatacattctcatggttcaaaccttagtaattataaaagagatgtagtgaagtctctcttttaccctctccctcatcagaccaagtcccagataattacattttaagtttcttatatcctttggaatttttttcctacatttatcagataatatgagcgtgtattctaaaaatataatatttctagtttatctttagcatcaacattaaaagtagttttttaggccagagtcacttgataagtatatattctttttatccttgaaactaatccttccttatctcctgctcccgaccccctcatttttgggcaaatgatagtagttcaatttttaatgtaaaatagtagagatttttattctagaaaacattgtccagtatcaggtgacacttaacaatgttattgacaatgctgttaaaatgagaagtattagaactgtgttcctgaaatcataaaatcttactgagggtaattcttagatcttttaatttgagctacagcccaagaggcttaccaaaaggtgctaggcaattattaatcttttatggctgggtacagtggctcacacctgtaatcccagcactttgggaggccaaggtgggtggatcatttgagcccagccaggagtttgagaccagcctgggcaacatagtgagaccctgtctctacaaacaaaaaatacaaatattagctgggtgtggtggcacgcacctgtggtcccagctattcaggacgctgaggtatgaggatcacttgagcccaggacatggaggttgctgtgagcccagatcatgctactggactccacctgggtgacagaacgagaccctgtctcaaaaaaaaaaaaaattaaaaaattattaagcttttatatggagatgtctatttggggatctggtaagaaactgaacactaaagaagctaccaagaactcagtggatactatataggagctttcttgatctacagcggtagtttgcataagaaatagaggcgtttgcctacctttttgagacatacatgcaaattgttagaagtaatggaatttcagtaacttaatatatgagtaacatagagcatttagtgagaccaagggtgggaatgctgtattatattgagaaaagggggagtatataatattaataaggaatataattaatttcttgccagatcagacctaattaacttctactaattatttaaattttgctttactttattaaaatatgcttatatcccatttctttttaaaaaattgaacttaagatgtatattataggattaaaaaatagtaatagatatggaacatcagaattaaaatacatttttggtttatttatatgtctaatgtaagcactctaagtttttattattgttgtttctttcttcctttactggaactcatgcttggttctatcattgattgcttggatataaaaagccactttttttatctgtaaaaggaaaccaggagatgaaatttacttggttttctatgttttttaaaagtactctagaaatggagaagatccattactagaactttaacttgctttaaaaaaaaaaaaaacagcactttttattttgaaataaaggcaggaagttagcagaaatggtgcagagtcttatgcatccttcatctggctccctcattggtgatattttatatggctgccgtgcaataatcagaatcaggaaattgacattggcatgttactgctaactagactagaccttagtcagttttcatcatctttttaacctgcattcacatgtgtgtatgtatatgtgtgtgtgtgtgtagcttagtgcaatttaatctgatatatagattcatgtaaacaccaccacaatcatgatacagaactgttctatcaccacaaaagaagtctcttgtgctgcctctttgtatttgcattatatttaggtatttctttttattttttgagagcaaataaaaatgatattacatttttaattttgatttccatgtgttcattgctggtatatagtaatacgattaacttttgtgtgttgattttgtgtccaacaatcttgttgaccttgtgttcatgagaatagttctgtgagtgtttttatagattccttggaattttctttgtagacaatcatgtcttacacaaataagggccgttttattttttcctttctgatatacgtatgccttttttcttgcttcattgcattggctaggacttccaataccattttgaataagagtggtgacagcagacaattcttgccttgttcccaatcctaggtggggaaacatttagtttttgtcattaagtattatgtttgctgtaagatttttgttgatgttctttatcagcttgggtaagttcctctctattcctagtttgctgaagttttttttttttaatcacaaattgtgttggattttgtgaaatgcttcttctgataatgcttatgcaatttggcaagtgaaatttttcctgtgactgttgccctccccaagcactccttgcaggccccatattgccatgcttaaatatgataaaaggagaaagattccagagaaagcaatttgggatatgaattcatattattgttaattctacatcaatgaatgtcaagcagaatttattatatactgctaactagactagaccttagtcagttttcaccatctttttcactgcatttacttctgcgtgtgtgtttgtgtgtagctttgtacaatttaatccaatatatagattcatgtaaggttctggattttgtagtttttctcctttcatagtaatatttattgaggtaggtagagagcaagggattaggagtgtgcactttggaaccagactttgttctaatgtggcctttatcatttactagttatgtgggaccttaagcaaactctttaacttgtctaagcctcagtttcctcaactttaaaatagggctaagaaccatctaatgttgtcaagattaaatgagataatgtatgtaagaggcttcatacttatgggcatttaatatgtgttagctgttgttgatgcagcactgatatgtttaacaatttattaaactctcttacattcaaagcattctgctgggcatttgggatgacacagggttatatgaagtacataattcattttagaagaatgtgctatttaattttcaaacatctcgttgtttgaataaatgaatgaaaacttttttatcttgcatccatccaagaccatcagtctttggtttttacccttccactccttccctttgtcatttatttttctctttctctctcctacccatttccctctgtctttctcactccctgttttttaggtaataatcaagctgtcataggtgaaccagtttctgcccctctgcttctttctgctctcatgggagttcctcctttcctttctccctcattttactttttcaggttttcatagttaccctgtaactgtattttaagccagctttccctttaatgttttccatttccttgaggaacctcagggtagccccactcatgttttactctcctgtttctgagccaaaaggaccatgatcttgactaagctctctcagagacacctgaatccaaagtaatgctaattttgaaatcaatgacattaacctctaaaagctttgatggtgcccagaattatttaatagaatcttcactaaattttccacttctctcttaattttcttctaattaaactttattttcttcaaataacagcatcatgataagttaaaagctttgacttaatttttgtttaattgccatattttaaaagaacttatttctattattttctcagtgcaaatgtacagtatttctgccactttatgaatttttaagaagttttcatgtgttgtcctaagaacctagcctcctttacaatattatttctagaggaaaatgcattctgtaaactcctaacaaataagccaactctagtgactccttttgttggtaaattgggtacttcttgtactaaatgttccaactggtagaggattgcaatttttgcaggtattttagagaaccaaaccagcctgtaattgcagtatttagttcatcttccttggaatgaaaaccatctaattagagttgccatgacaactctgttttcatgcagtataacagacctattgatctgaagttcaggttgatggagcatgtgtacgtgttagtgacagaagccaacatccaatatcgtacagagtgttggctccatttccctcctagcttattttctaccttatgcactcacaagtatttattaagcacctactgtgtagagagctcagagaagcccatgaaatattcaccataagaagaaagaaacagttataaaaccctatcgtggatgtagaataaaaccccagtaacttaccctctccttcataatctggccttttcctggacatttgactctttcttctcccacctccccgatacccaccactttggccacactggcccctttctgtgtttcaaacacttcagcctcatttccacctcagggcttttgtacttcacattcgctctgccagaaggtcatttctccacctctttacatgtttggctccactttatcatttgagtctcagtttaaatttatttccacagagaggctttccccgattgccctaaagttgccacctgccgtctgccctcatccattgtcatgctctttgacattatgatatttctgtttctttcttatattattattgcattgtctcttattagcatatacttttctatgagagtaggatatggcagtgtcttgtttactgtcatatctgttaatatttgttgaatgaatgagtcatagagtgattgaatatcataatggtcaagaaaagtttcataaattggcactgatttaagtgctttggaagacagtggatatggctgggcagaaataatgctcagaggcattttatgtgtgaggaacaatctatactcaaaagtactgtatgggtcagtttgttcaacaagagcatttctgagcatccagttgaactgtaaggaagggaccacttggagagtgattctttaattttcacagtagccctgcgaacctaattattatccccatttcatagataagcaaactgaggcttagggatgttttaaacaacttgccccaggggcagtatactaagtgatgaaactgaatttcaactctacattgccagtccaatttcagagcaagggtgcttaaccacctcatttttctggttcattcacacttcagcttaatttttttaaagtttttatgtcatatcatgccatatatctccatgcttttacttgggatgctgactttcctactagaagtaaattgcttgatgttcagtctataggtatttattgcttgcctactgtgtgcaaggcattatcacatattaacagcattaattgaaaaaaatcacctagccagttacagtgttcgagaaaactaaactcattgaactcatattttctttcttaaaattctctgtatcatataacagtggatctaatataaacataaaaatttaaa

SEQ ID NO: 1117 - DNA, 1652 bp, Homo sapiens
gaccagaggagctcagaggtcctcaggatcgagcacgggaagctcctgtgtaattgttaggcaacatcaaaatatgcaaagcaatagccacaacagaaaccaccaccaccaccaacaaaaacccaaacaataaacttgaagtttgatgaccagttctgaaggactaacagatacaacctaacattgttaacattgttctgttgttttgttttggttgcccaaacaacgttattgaaattaagggggaatccacttacagacctcatcacctgaaaacaaaacaaccttttttcaatatttcctttattttggaccaaatcttgccatgtatttgcttcactgtaaaaaaacaagaaaggaaaaggaaggagaagaaaggggaggggatggaagaggggagaggaggagcatggagtggatatgctatgctggattcacctgttctgttgctgtgggatttaggggcgtttgttttgcttttgttactacaaataatgccttgaaatttcctttgcaaacactgagacaaccatgtcaatctattgcttgagataaattagctgtagaacgttcacatgcagtaggagatgagagcaaaaaaagggttaaaagaatcgattttaattaagcagaatgtctttagccactcaagtcagcatccttcccacagatttttgatgctaaacttagccccttctaatgctctgccatcttcattctgtgcctgaacttattagctaaaccttcaaatgaagaacatcaaccatgtgacaggttggctggttaaaatggaaactctgaaacgatatttctccttctgccttattgattgcacacagacaggtcttgattaccacatgttacacagcagccctgctgactgtcgatgcacatctggagccaggtctcacccctcttcctcttccctagggccatgcaagggccctcccagagagccaggggcagcctgcacatctcccaccggccttgaatttagactttggatgtcacaccctctgaggttacacacacacaggcacagaagcatacacaggtgactgagggaataagactcttatcttccagctttaagcttctgcccattactagactatactgctttcagtgtactgtgaatgaatatttccacctacattattaagtgatgcattctattagatgggtataatatatacttattataatttaagttataaatcttttaaaaggttattcagtgcaaacattttaaaacactttttaaggtctctgttgtaggatttttagtattttttaattcaccaggagtcttaaaaattggataaagcttgggcctcccttggtgggggtctcactgctcacgaaattcattcaccttcacaggctgtgccttgagtggccaactggaagatcacacacagcatgagacagtcccttcctgacagcagagacagagaagacagagtccaggcagccctagcagagctccagggacagttaacacccacccacactggttattcattcttttgttttaatgaatccaaattttttttaaaaaaagactcaaccatggtaggtgtattgaattatctagattatccattgattatgacatgaaactacaggtccatgatactttttctataacc

SEQ ID NO: 1118 - DNA, 1822 bp, Homo sapiens
ttcaacatgcaccaccaactttttgagttttaggtacactaacttattgtgggatctgggccagctgctctacctctgtagacatttctaagtgggaaaaaaaaaaaagatttaggaatagtacccttttcagattctctcagaattatagttgtaagcactatgtaaattcatagaacatagttttgaagaccagctttagaatttcaatagttattgtatattcaaaacagctacacaagcactttattttcattttaaagatttacaattaaagtcattttatgtatacctcaaatgcctgattatacacaaacccattacagggtttatacacacattaaatcccttcttattatggggttttgtgcacattaaatgcctggttgttatagattgttgtttttcttgttaccattaaatgtaacatttccctaggtgatgaaatgtattattatttagaacatttattttagtgtgtgttctgtattttaaaagagaaaggtatttaagcagcaaagatgtaactgttatgaaatttatttttataaatagctttcagcagaaatcagaacagtgctttaaaattacagttaaaaaatcatttaatcatcacactccttgatggctaatagagtagtaagtgactcccccatatcccccgcaataggctattctcgatatgctcacttaagtggccctaagaatagtactagtatattttatgttagcaagccttgatagcaaagtgccaaaagttcagggggcatttgtctcctttctcaaaaattcatttaagtcttgctggagctttaactggggcagacagccatacaaatgacttgagataaaatgaaaataatggactgagctgggtgctggggatggtagttatgctgagcacacatcaataagcttggagtgtgattctatgctaatgcaagcctgatggatcagctttctcttttagcctggaggaccattaagctctggaagctgagtcaaactgatagagttggcaaatacagcccatcagttagcagcaatagttaactgactgtgattcctaatatgcgaaactaacattgcttaaaaaccctccatgttcaggacatagatcagaaaggagataatagattctgctttaatttgcataatcaaagcttctcattttcccaccttatagttaacagaagagggaaaaaaagccatggctaccttcattttgttgttagtcttgaatcatagcaaataattttcataaaaatgtaaataacttgtttcaaaataaaagagtatatttgaaagattctctgtgttatttctttggaattaaactgtaggcacagttacatgggttgggtagtaagtgtcttggggatatgaaaagtaacaaagtcttaaaaaattgtgagtctttttagtgattgattattttcatatataatttataaagttctatacttttacttgaggatattggctttgcaaacttatcaaaaacagttcaaattctgttgaattcatatttttgtgttgtgaggactttctgttcatttaaaaacatttgttgagcacccatttatttcaggcactgcattggacactggtgatgtggttgtcctcttggagcttacttttttttctttacaggggaggtaataaactagtaaacaaagacataatacagtttcagtgagtgatagattcttttttttttttttttttttttgagacagagtcttgctctgtcacccaggctggagtgtgcagtggcatgatctccacttactgcaacctccacttcccaggttcacacgat

SEQ ID NO: 1119 - DNA, 2354 bp, Homo sapiens
gaaaaaaaaaaagatactggaggatcggctccaacaaaatgaggaagttagccaaaaaaggaattacgggttctaacaaaaaagagaggcaaaggaaatgtccaggaaattccaagattcgactgtaaattagtcagagaataatcagccgaggttcctcagtcagaagactgagggagaaatcttgaagatgataaaacagacaccattaaatgcgtctaaaaaattcaaaaaatggtttacacaacttaaggaaaattgggaattaaactgttaaaaagtacaaagaaaactcagaccaagagaggaaaaacaagaccattaataattttagtgaaagcaaagttacataggaaaggcataggaatcatagtccaccaggaattcagttgaaatagttttcttatataataatgtaaaaactaatattcatataaactacatattgccaaagtttactggtgttttcaaagaatggaagatgagaatactgcaagtatttggggagagaggcaagcagcaagtaagtgacagttacgtctttacttcccataggagataatgcctaaaatggaagaaaaatcaagaactagcaatattagcatgttatttagaaagacatcaaaagaatcacctaaagaggttgccgctgggaccttgtaatggcataggagttccccttggggaattgcttgacgttttttgtaacaagcttagttcacctatttgaatattaaagctttgaaagaatataaactaaaaacaaaactctcacagctaatacgcctctgggccaaaacttgaacctgtgtgatttaactcttaatcaggcccattaatttgtgagctcctcatgggcctgtgcttcttagttcctccactacaatgcctgcctagcccaagtaagctctcagtgtgtttttaaataaggaggagaaagtgaaatcatgggattgcttttgtaacacaagtaaatgagcaagaagggcattccagatagaggaaacagcagaagcaaagacaggaaacaaagcgtgtgagagctgaacaagcatgggcaaggagggaggaagacaaataatgagaagcagccagaaaacccactgcgtgtgtgaaggaagatacagcaagaacaggaatctggagctatgtgcaggggagtggaaggcattggtgccttacagacaggcccacgtggtcttgactgtatgtatatggcccttgggagttggctggtttgttgtgcagtgctgacagttccttcccaaatagttttggctttctaaaatctagagtagtgccaggctctctaacactctgagtactttcagaagtccaactgcagcctaactagttactctaagcagccactgaaaaggccacatagggtgaacaggggcaagcggagcctgatgggatacctacaatgccaccctctccattgttggatccctttctgctctttaaaaagcattaaaatccagggcataaaaggaatcatcatctctaggtgaacatatgtatctgctattaccattattcaaatactaatttcttccaaagtttattaagcatttacttcatgtcaagcagtatgttggagcatacaatttctgattttaaataacttacttcctgatagcagaactgcttacaatataacaggttaagcaatataattggtataaaacaaaagcactgtggaagcacaaaggaataaaaggctatatattcaaagtttcttatgtataattatgtataatattacatattattatattattaggtataatattatgtataatgtcaaacagaggtaaaagaaagatgctactctaacaaattcccatatactcataattctgctttgatcaccatcaactcttgaccaatcttatttatcttctaaactcactcattgttctaaggacattatattatttcctccatatatatttcagcatggactctttctttaaacatataaatctgcatcttgaaaaatgagtaagttttaagaattgaagtctaattaacataacaaaatgtgcagattttaaggtgttcaattgagttctgacacatatataccctgtgtaaccactatctaaaacaacacacagaacatttccacggcctagaaagtccccgtatacccatttctagtcaacttcccacccctgaataaccacgttctgatttctatctccacagataatgttgcctgttcttggacttctataaatagattcatagagtatatatgaggtttctaggttttggtctaggtttccaggccaaaaaagggggaaagcattccaggtcgaaagaactacatgtaaaaatattaagtt

SEQ ID NO: 1120 - DNA, 3642 bp, Homo sapiens
aaagtttattacaataaacaaaatagttacactccttgccttcaaggagcttttggtggtttttgtatccttttttttttctttgagacagggtcttgctctgtcacccaggctggagtgcagtggcatgatcataacctgaggctttcaagggatccacccacctcagcttcctgtataactggtgcacagcaccacagccagctaattatttcttaattttttgtagagacagggtgtttctatgttgcctagtctgatcttgaactcctggcctcaagcaatcctcctccctcggcctcccaaaggcttgggattacaggcatagccactgtgcccagctagagcttttgatcttaaaagaaggcattaaatcctaagtatttccatacccttgccagcactgagtttgtgcagtttaaaaagaaatcgatttcattttgttaggtaggaatggtgttttttgttgtcattgtttaaattagtgaggctgaacaatttttcttgttcatttatttattcatcagttgtttattaagaatctgttatataccaaaacaatgctaggcactggaaatatgataaagaagatggacatgtgttttccttcacagagtttataatgtagtaattattggttgtgtatatttcttcatttctaaattgtatcctcttccatttttccattggagcatttatttttaagaattgatttgagagtgttcctttattcaatcagtatgtagtgaactaccatgtactaaacaatatggtgcaaaacaaacagatgaggaaaagaacaggtgaggatgttagccaggcatggttccatgtgcctagagtcctacccacttgggagaatgaggcgagaggattgcttcagcccaggaacttgaggttgcagtaaactatgatcacaccactgcactccaccctaggggacagagcaagacgtatttttgttttcttagagattttcattaccttgtctagtttcttttgattcttacttgccttactgccagctcttcctttttacctcaatctgtatacttcatatattacctgttttttagtatccatttgtcttgttgttgttgttgttgtttttgagacagagtctcgctctgtcgcccaggctggagtgcagtggcgcaatctcggctcactgcaagctccgcctcccgggttcacgccattctcctgcctcggcctccggagtagctgggactacaggctcccaccaccacgcccagctaattttttgtatttttagtagagacagcgtttcaccatgttagtcaagatggtctcaatctcctgacgtcgtgatccccccatctcggcctcccaaagtggtgggattacaggcgtgagccaccgcgcccggctttttttttttttttttggggggggggggcggggagacagagtctcactctgttgaccaggctggagtgcagtggcgtgatctcagctcattccagcctcaacttcctgggttcaagcaatcctgcctcagcctccaaaagtgctgggattacaggcgtaaacccccatattctcggcctttttattgaatttttattgcaaacataaagtagttttgttttttgttttttagatggagtctcactctatcacccaggctagagggcagtggcacaatctcagctccctgcaacctctgcctcccaggttcaacagattctcctgcctcagcctcccaagaagccgggactacaggcctatgcccagctaattttctgtatttttagtagagacagggttttgccatgttggcaagcctggcctcgaactcctcacctcaaatgatccactcgcctcagactctcaaagtgctgggattacaggcgtgagctaccacgcccagcctcttcctcatcttgagtgctgtgttttctttttatatgctgtagaatcttctcataaacctatgaggtggttgtaatttttttctgtttactcatccttagatgagcagtgttgctatgagtcaatctttttcttttaaagacttttaataggttgttgggagaagcttagggatctctagtcagatgacttcttaaattagaacttaagacttttcattttgaaaaccggttgtgctgactggaatgggcacattaaagaattgaactaaggctgggcgcggtggctcatacctgtaatcccagcactttgggaggctgaggcaggcagatcacgtgaggtcaggctttcgagaccagtctggccaacaaagcgaaaacccgtctctactaaaaatacaaaaattagtcaggcatggtggcaggtgcctgtaatcccagctactcaggaggctgaggcaggagaatcagttgaacccaggatgcggaggttgtggtgaacccagacagtgccactgcaccccagcctgggcgacagagcaagatttcgtcccccacaaaaaggaaagaatttagctaagacgtctttgttatacttgacataaaatatagagtggggttcctgaaatggtcagggaatattcctggcctaaccttagtgagacatgtattcttaagatctttctcccttagttcacagcctcttagttggatgcccctgtgtcacagaacacattttggctatggggtgtgatctgtgtctgaggaacaacaagaagctacacgtcatccacacaggagccaaatctggaactctggtctcagttcttcaggactatttgagcgaataatcactcaacactggagtaaaggatgttctactagaagtcttattctgactcctaaaaccacgctaccgaaagtgttgatccacaaaccagtgccagtgcttgaactttgttactggtccacagttaggtaagtacagaaatggagaataaatgtgaagtatgcgtaaatgatatatgatttacagtccaattgagatgcttcaggagtgaaagtggggacaatgaaaattatgctaggacaaaaatcattaactggactgtccaggtaaactggaacatatactcacctcatccttagatttcactagcagtagagtcctggggacacaggaaccaaatgccctcctgcatttctccattcctgagaggaaaataccctaattcctgaatcccagcctccacatacttcttaggatagcctagcaattacccctgggccccttgtgacaccatttcctaaaccagccctggaaactcacttatgattggacactatgtcttgccctcttgcctaagctgagaactcttaaaaatgactgtctttcccctagagggtattttggagggccaggcaccagtccttagccatgcctccttgtgaagttttaaaatatgatgcttggttccatatgaaatttaaagtagttttttctaattctgtgaagaaagccaatggaagcttgatggggataacattggatctatacattactttgggcagtatgaccattttcacaatattgattctttctatctatgagcatggaatgtttttccatttgtttgtgtcctctcttatttccttgagcaatggtttgtagttctccttgaagaggtccttcacatcccttataagttgtatacccaggtattttattctcttagtagcaattgtg

SEQ ID NO: 1121 - DNA, 2552 bp, Homo sapiens
aaagtttgaaatctgacgtgaaaaacttcagatttgtgatgtttgtctccatgttgtttgttttctgctctgagagatgccaacaagtggcaattgagttattcccaggtcattgaaaagtgaagagaatggatttctagaactgtataagaacaaggacttgacgatttaaaattttttcatataaaaaatgggaatttgttcctagcaattcatagaaaaaagtgtgtgaaagccacctaaaaagcacgagactggcatgcaaagctttatctgccaaatgttataatagaaatattttcataataacataaaacagtaaaacaacaaaaagtttgtatatgtctctgtatgcatacaaatagagaatgtatgtgttatttatttttctaaatgagcatacattcctgaactaataatgtattacatacattatacaatatacataaaagtagacatttaaaagaatggcatacacttttaaaaacaacattctatttgttaactgtatacgatgatacagttaatattagctgctgtaatagagtatctttaaaatctcagagacttaacagaagttttcttcttactacataatatctaaatgggtctttctgatccataggtcactctcctccaagggaaacttcaggaagttaggctcctttctacctgtggcttcttcgtctttaacacctggcttccatgtttgccagttgggagaaaacaaaaaacaaaaaacaaaaaacaaaatggaggttgattttaatgagccagattgagaagaacacacagcactcactgatgctcacatttcattggctagaatttgtcaattgaccgcatcaacttcaaacgagagtgaaaaatatagtctcacattgtgtccacaggaaaaagaagcgggttcgctggtggcacccagcagtcttctccactaacaattacaaatataataagtttgctttttgctaagaatgaaaatcaacaaatatatctcaaatagctacatttgctggtgttttttctttttaaagatttgcaagtcataattgcttataccatcatgagctaatatcttaaggacactgggatgagattcactgtcagcaataatagatgtaaatacatattttaacttctcagctctgatgagactatatgttttttcagcctcataactagttgacaaagagcttgtattatgaataaaggcagtgtcagctatgtgttttcttatagtttacttatgcttgtatttttagtactatcttcaatctccagtttatagtcttttaaagcctgttccattctgtgcataggtgtgtgtgtgtgtgcaagtgtgtgtgaaaactagaaaatttaagacttaaacccacttaccaggcacgcattaaagtataagttcatccctgcaattcctgaatttgtgggaacttacccttccctcaagataccccatttatcacatgtgacatgtgaccatctaacatagggatgggtggtggtacaagtgtaagtccttacatgaaacagtagtcaggatacattgttttatatttttagacaaaaatcaatatagagtcctcatatttttcctgcatctcaccatcgactactccctatagagtatgtgcaccctgtgctggagtccactaaccttaaagaaagaaaatgtcaaacctcgtgttcatgtcaatcaaagagtgcaataaaaagatgatgaatgttgggataatgggaatttgggtaaacagaatcctttgcctaacatactattgattggaaaatattttgtgtctattgtgctttcagatttgtttctactctttcttggaacagtctagctttactttgtttcattttgttttaaccttagtaaatgcaaaatagtgattcatcaatggaattgaatttttaatttctagggacattccaaacagctttcctgagatgggcactgatccttaaaatattttggaatttgaaaaagaggaatgccttcttacccatttaaaatccctggttctaagcaattgtttcttcagtgaatatctggcattattttagtgtcttaatttttagtgtcacttttcaatggctgtaagtgtagacattgaaagttgtatagattttaggataacctaggttggcaatagatcctttaaaccagtttgtttcttttcattgcttggtttattgtgttttatcaaatcaaagatgccatcaactgtaagatatatattttagatactctaagagaaaaattaagttctatcaaatatatctttaaaatgacataaattgtaagactcattcttattttgtatatgttaaactgtggtaaaaatgtataccttagaattaatgaaatacaaagtattctactgtcttccagcaaaggtttcaggaaactttaaggatatataaagtgcagaaagattaaaacatcttaagggaaaatgcttttaagaaagcaagatgaatgtagcacaaataagagccaggattgagactaatttggtaataatcatcattacgtcatatgcctt

SEQ ID NO: 1122 - DNA, 1764 bp, Homo sapiens
gggcttataattttttaatattctcttggcctagctaaaattataattttaatcagaggaatccattgtaatgaggcaagaatagatgttctcttaagatcatccatgtatgaattgaagtttacctgggctcctttgactgactttgtcattttccatctggtgacttttgataaaaaaaaaaaaaaaaacacataaaaaaaatctccagtgttccaagcctgcagagaaaaaaggatgaaaatgattatataattgggaagttttattatcctctggttttgtgtcatttacttctgtaacactgtttttatcgactgccaagaaatgtatgtgtgttaccatttctttgatcgtcttggcctgcaaattcaggataaagggcacaaggaaaaaacaaacttaccattttcacacaattatttataagaaaaataggactggaacccatttctgatcacgatccttttgaaccaataaaaggaattactaaaaatgtaaggagtgatgttttttctctcgcaattggtactttggctaaaaataaaccagtcaaaaatagaaagaaaagaagatgggtaaggtctgttaagaaacctaaacaatattctgtggcatcatttctatcagcacacaaacatctaaattctccctcacacacttatatatataacttgacttcagtatctctctagctatttccccattcctttatccctttggtaacaaaacttcttaagggaagagctattccagtatttgtattcacccattctctcttgaggcctctccaatcaggcttttagcacctgcactctgccccaacctacccttgtgaaggtcctgaatccaatggaggactctcagcccacctcttactcactatcagcagcttgggcacacttgatccttttcttcttgaaatacttctttcaattggcttccggaactcacaagctcctgattttctcctccttcatggatttcttttttttcattccatattaggtccttctcatctccctgatctcttaactctggagggcttcctacctcagtctttggacattttcgtagatgcacacccacacccttagtgatcttctccagggtcagggtttaaatatcatctttttgttgctgactcccaaatttatgtctttaactcaagcttacctgctaaactccagatccctatatccaactacctatgaaatgtcaacacatgaatgttttattggtgtctcaatcttaacattcccaaatgtcttccctcagtctcactctgccacccaggctggagtgcagtgccatgatcttggctcactgaagcctcgatctcccaggcacaggtgatcctcctgccccagcatcccaagtagctgagaccatggccctgcgccaccacgcccagctatctttttgtattttttgtagatgtggtgtttctccatgttgcccaggctggtcttgagctcctgagctcaagtgattctcccttcttggcttcccaaagtgctgagattacaggtgtgagccacaacacatggcctccgaaactaaattagtgaccatccctctctatctgctcttcccaagtccatcaaagtcaactctatcgtcctagtgctttatcccaaaagccttggggtcccttcatcctctcatattccatgtctaatctattagcaaactctgttgcctctacactgaaatagatctgggcacttactgtttctcaccacttccgatcactaccaaatc

SEQ ID NO: 1123 - DNA, 2607 bp, Homo sapiens
tcatggttctgcaggctgtacaggaagcatggctctggcctctgcttctgggaaggccccaggaagcttttactcatggtagaaggtgaagtgggagcaggcaagagtaaaagagagagagtgcccggggagaggtgccacacacttttaaatgaccagatcttgtgtgaactcagagatctcacttatcaccatggggatggcacaagccattcatgagggacctgccttcatgatccgaacaccttccaccaggtccaccctccaacattggggattacaattcaacatgaaattggggtggggacaaatatccaaactgtatcacctttgtagctttctgcttatactcctcaagttcttccattttcctttctctcagcatcggagtgcctgattttattgataaggggttcagtttgatcatgatgcatttccaaagctccctttctctcttcccaaggtatttatctaaatttcacaaaccttaaaaaggaaatgcctacaagatcatgtttgaaagaggtttatgtaaatgtccaggaatgaaattattttaatttctgcctttccaatttaaaattctgtattcatctcctaggtaggtacccccatgtgttgaataaaatggcacatttgttgctgagaagttctaagacagcagaattttgccctcagcacttcttaaggaaaatggtctctgtgaattaaggatttatgggtgaccatgcttccgctagaaaggtttgaagatctggacttacatgctgggatcctgtcttgattaaaggctgcagagaagctgatacagtaaatagtctttgctatctgtggactcatatttcctgctagagataaaccaagctttgtgctatatagcaatcagcgagcaccgcagtggcagattcagcgctctgcccctactaggctgacaccttcaattggaaatggcctcaaaatcatgaatgttcacttcggagttacaggacgtggggatgagttgaatgtattcctccatgtgaacacttggtcactttccccacattacactgtaaaaccaatttttgtggttttatttctctgagtcctcattaatgccatttaacaggaaattcagctaaagccccaagacaagtgtagagatttcgaagaaaacttgctttggactgctttagcagagtgcctgtgtattatatatgtgcccacgaatgtcatcaccaggggagaggagcagtcacatgaacgatccaacctaattcatttatatttgattttgaaatgcacagcgctccttagactctcagtaacttttcatggaggtgggaggggtaatagtaagaggagcatgtgttctttgagctcacattgcataatggaaataagcaacaaactgtatctgacattccatgtggatacttagctgttgacactggatttagggttgctactcaaagtgtagttccggagcagtagcatcagaataccctagaagctttttggaaggcagtttctggtgtccacacctcaggatctttattttaacaagatccccagctgattcatttgcacattatcttttcctttttcttttcttttctttttttttttccagaagggttgtttaaagccctgtttcccaaacatggctgtgcattgggagcaccttggggggagtttttaaaatactgattgacacctgggtcctgcagtcagagtgcccgattttattggtatgggattcagttcgatcatgatgggtttccaaagctccccaggtggttgtaaggtacaacagagtttgagagcctctagttcagagcagaaccagaatgcatctcaggcacatgtgaatggtgaagagttgacaatttctgaaacagactttcaatttgtgacctggcattctaccagccacaaatttttatttgtgttttatccactcatatgttagctgtcttcttaatcaccagagacaagtaagttatctatttagtttactgctttttctattttatctgcttatttgaaaattgatggatagctttggtttatatggttattctagaccagtcaaaagatttgcttaattgaatttcatttccgaatatgttttcagagggaaggttatggtctaaagaatgtcatttaaaggtcttaccaatgctatgcagtagttatttctcttaaagcagcaagagctgagatttcaaaaagttaaataactgcctaaattgcacagccggtcattggaaaagccagaggttgaacttggcatttgaaaagtctttatctgattcctaaagcccgtacttttctgatcctccatgctgtttctggaaaaacgtagctgtgtatgattaacagcaactttaaaaagagcatttctggtttatttttgtgtagccttatgcagtgtacacatagacatgtgtagctttttgaaattttgtgtaagacattccaccaaccatcactgagtaaacgtagtatatgcccttaggttctgatttaaataacaacaaacaagcagagaagttaggggaattgaaggtgactgaggagcacaaggtattgagatgtttgttaggtgcgctgggtagggtagct

SEQ ID NO: 1124 - DNA, 2166 bp, Homo sapiens
aatcatcacgcgaaacaggactctcacacagctttggcttcagacaaatatagagtagtcagaaacatagctgaagctataaactctgggcttaaacttgtcaggaaatgttcacttgttttcatcaggccataccaagaagaaaagaaagatcatatgaccaaacagataaacaaaaatgtcaaaccaaagagccaaagggtactaaaaacagaggctgagatttttgcaaagcccataagctcaccttatggagcaaagcctatcaaaacagatgacaccaacataaaccccaacataaaggagcagaaaactaagattaagccaagactactaatgggcacttagggacccctaggtctcatgaaaggcagaagtcaggctggtttccccagctgcctaccagaaaaagttgtattttggctaagttcaaaaagtcagtccagacttttctcctctctcccagtaagaaagactctgcagtgaacgttaaatatttaccccaagccctgccttgcttattttttgagagttaccttgtaaataaaacaactctagtatccaaaaacttagaagtattaggaggatgctaattgtatgagatactcatatagggcactgaagccttcttccagcaatccctggggtatcctacaattgctgggagggattagaggacagtcctgtatacttctgcctcatccttgatataacaataacaaaatacagacatcatttccaacaacaatagtacaataacaaaaactagaaaaaacatcacgtccagctacaatacaaccctaccaccaaaaacagtgactaatacttaatatgtacccaacaccattttcctcttgttaaatgtaacatcttatttaaactccacaagaattccattttgcagatgacaaaactgaggcacagaaagggaaatatgactaataaatgaaggagccagtgctattcttagccatggaactttactggctccctaagagccatactagttgatcccagtacaaaccccttcttgtagcctctttctctaagccatacttcctcttctccaatattccatgttcccctaatgtcccatttctcccccagtatttcaggacattttcttgagccctcctgccatttatttgccctaagtgacgtcgggttgtcccacagtgcttgaccttattattttcagatacatcaggaaagtgtccgtaaatcgtctgacctctacccacccagtccctaatctgccttgcctatggtgaccctttcttgccaccacaagccacatcccacaccttcctctcactcactattccaactgatagcctcccctctggatgacaaatgtgtttctgttcaccatgcctattcctgcacaccagctttgctcacttcccacagcctattaaccccctgctgtttatatcacaaacagccacgtcaacaccgcctgcattagccagggtgctctcttttaacctattgctatgcctctttatcaagccacagtgcttctcacagcctcatctcaccacaatgtaatctcagtctatgtttattcgaccctgacattgctcagttaactaaaatttccacctaatgtatttttaattgagatatgatgccaccatcctatttatggtgaataaatatttgtaaaagataacacactatgttagtgcagttatggtgaaacagtgctttcacatactgctggttaggatttaaaaaatgatatagccttctggattgtacatgtaagtcaagtcctagtaaaatcaccactatgtaaatttgtgtctgtaaatcatttcctattaaaatttataccattttacgtgataatttgattttcatgattccatactaagcaaataatcagacaatccccagaagggctgacccttcccctctatacccacccaaatctacacatttattaaggccacggattttctccacctctgagaaactttaaggccagaatgagctctctctcctctgaatttctaatatccttagtgtctttgcatctgatgcctggcattactggtaattaatttattcaaacttaacaagctttgatgatacccgcaataaactgggagttatgttaacactggagagacaaatgatatgagacacagcctgtgatct

SEQ ID NO: 1125 - DNA, 1485 bp, Homo sapiens
cgtgaggctgctgtcagtgtgtcagctgggttgcaggcctctgaaggcttgacaggggctggcagggcccattccaaggcagttcatccacttggctggtgggaggcctcagccaccagcaccagcttgctggccatcgagccgtgtgggcatctccacaggctgcctgagtgtccttgagatacagggactgacttccttcggagtgaatggtccaagaacatgcaaggcaaatgcagctgtgcctttcatggcctggcttcagacagcacatatcttcccatctgctaactgttctgcagttagaagtgagcactctgtctgtcccacactcaagggaaggggaattaggctccacacgttgaagagaggactgccacagcatttgtggacatactttgaaatgcctaaaatatttcgatttcaaacctcctctatagaaatattttcctgtcttttcccccagaatctaatataataattgctgtctttgaatttttttcttccccagttttccatttaacagtgatgcaaatctagtgcccacctcactggctgcatttttcttaaaatgtcaggggtacctctatttgctccctgttttttcttcttctcaatgactctctgcctatgaaatagacgagcaccccctctgaagtgtgcacaaagaagcctgggttctcctcaggtgggcagcctcacctgagtccgaaatcgtgatggtctcagggacaggcttatccaaacctggatggagtatggaggaggactctcttcagggccgtttgcattgtcagtcttataagatggattttttttttgagaagcgtggcaactcaggatggatggaatcacaagaaccacagatcctgttgctggtggttttaagcactcatcaaagcatagccttgaatgaggtggagaacattttactcatcacattctcctcagtgggatgactccatttgttctgaagacattctctgttaagctgcttggagtcgtgtatgagggagagcccaaggcaggcctgatgtgcctaagacaaacaagggaaatttgtcctgctaggcaggtggagctgtgggactaggaagctagggagggccatgtccctcaggatgcatcccctccttgtgaccctagtcccaattatttaatgggtttgaccaagacacagaatgcagatatgtatggagttcttctgcagactgctgaaggggccaagttctggggaaagagagcaaaacttccaagaatgcacaagttccaagtacaaaggagacagtagaaacagaagacccaggaaccagggggaaagctttggatttctcaagcatagaatctgttggcagccaagttgattttaccttgctcttcaggggaaaggagactcctggggtatcaatcatatatatgggctgtcagagcgctgtacacccaaataacgtcacacacccttctccctgaataccaaagctctgc

SEQ ID NO: 1126 - DNA, 2892 bp, Homo sapiens
atctctagataggcatctctcacacttgcttttggagtactgttttagtagcttacttgtgttttttaaagttcatttctccacccacaggatagctccatatcttccagcaccactaatgagtaagtattagggccaagctggtatctgcagagtgctgactggccaagagtctgcctgtgactcatgccttaggctgtccagcattggggtgctggggggctgtagccataacatttgcaggatttggaaattccacctcaagctccaatcccagggtgttgattctggctaaccatgtttatgcaaagcaatccaagcactttgactcactttgggaatctggcattcttgggcttttgatattgagacagtggaacacttttgtatcagtttaggttctgccaataattgctatccatttaagcacttgattttttacatatttaccagcaatttccaaggctttaatggatagagttagcactcttctgcaaggagaaattgctccacagtgctaatagtcgtggattcacaggcactcagtgagaatattttaggcataagcttagttttattattgtaccttagagaaaccttgtatttttaactaggtggtaactttttactgtattagttaatcaaaagaaacataaatataaccaaaatgttatttttagtttgtactggattctataaaaatatgattacccattctagctttattttgatgttaatatttacatttaaatagaagaaaaacagtaaagggagcacatcaatgtaagaagtgtatggctttagtaaaatatataagaaactttggtaaacagggatttaaaaaactctaatcccttcaccaactcagaatgccagttccttacaaagctgcatacctgagcaaccacacatgtggtttctgtggatgagacatttaaatgatgcaatcattttgggataacagttatataatataaaggtttcacatgagtgtctagctgaaaaaccactgcgttttcctatgaatgcaaagaaacctctgctcaggtgttggaagctgtgcctctccagctgcctgccaccttccaccccttcacctgtggcttccgctggtttctgatgggcaccctttgatcactggggtcagttcaatttcctgggccactgggtcatgggcaggacatgaaaatgtaagaagagggaccatgcggttcacctaaatgacactcatttaataacaacatcaaaatccttgatgtgacaggacctatcgcctggcatactaaaagtggggagagcaattctctcatcttctgctgtagttaatgatatcttcctaaacctgcattaatcatcaagtgaacttctagggataacgtaacttctgggagaatttaaactgagattgaatttgtatctcagacggtagtgcccacagaggtgggcagtggcacaggcttccttcagcttgtgtcccaggtttatgggagaactcttctccctgtccctcaattcacacacaaaagtgcaaaacaggattatgggcatagggcatgggcaatttcatctacagcagtgccgatctctgcctcactctttgaggtcaccacaatgctttccttctgttcagaaccataatggtttctgtgtatcaattgtttgtgggcaactgctgaaagggaatcgagggataaacatgattctaaccaatcgcattctgtggtgtctatgggcttccacctgttaacatgggaaactttctgaatttaggttcatccccatcttgtggaattggatttccaccaagggttcctgctcctcatttagcgtggaagaaagtggattttgcaaataacattcatgatgttttgggcagtatctactctgcctgcaaggtaagaatgagtctgtgggagaacatccagctgctgcaacttgcttcaaagcctcctttttttttttttttgagacgaagtctcgctctgtcgcccaggctggagtgcagtggtgcgatctcagctcaatgcaacctccgcctgccgggttcatgcgattctcctgcctcagcctcccaaatagctgggattataggcgtgtgccaccatgcccggctaatttttgtatttttgatagagacagggtttcaccatcttggccaggctggtcttgaactcctggccttgtgatccacctgccttggcctcctacagtgctgggattacaggcgtgagccaccgtgcctggccaaagcctctgttttattggcttctctttggtgctcaaaattcccacgttcacattaccttgtttatttgaggtaaaggctttcatcaaaatcttcagttaagataaaaatggcaggaagataaaggtggggacttacaaattacattcttaaaagccacccacattttggtttatatctcttattaaatctgcagtacaaattggtttgtcagctctgtttacctgaaagtgtcctgagggaacagaacacatggcagagaagcctgtctggcagaattaaggactaggagctgggaagttccagagcttagaacaacgtccagaagacagacttgcaattgtgctgcagaaggacaaactgttgcctgttggcagaagatggggacagggggaaggaggaagcacagaaggaggaacagaaagggccaaagacaatgtctgtctgttgtgaggtccactggggctggccttggtcacctgcctgacctcctcggagtgagcgtgagacggtcacgtgtactcagggattgaggaggcccaatgctttcacacttcgtaaattcccggggaacactccacactcatactgaaagggacagtgtggccctgactgacagcatgtccaggaccagagtactaggcatg

SEQ ID NO: 1127 - DNA, 2034 bp, Homo sapiens
ggcctccaggtcttaaggtggagcacggccaacttggctggctcgagatgagattcccatgtcttttatttccaaagcagtggggcctgacatgagttgagctgctcaatgttcatagacagctttgatattatgtgcaaagatctctaaagtatatcttacacttaagttactttgagattaatgaaagtgcaaattcctattgttgttttacatctggcacttttctaagggagaaggcaagagatggcccagaaaaagaaaatacacatttagaaattggcaaccacttttctgtgggaatgatcttttatttttcctcatccccatcctcaaattatgggacaggaagggcgggtgagagctgttcatgatagggttttggaatagggtgagggtagaaggagtttcagttaatatcttattccctagttgaatcctggcagcaggggaaggggggaggaagattcagtggttgctgcatccatgccaaggtatacaatatatgggtagccaaggaggtcagtgaatgtccagatagaaaatgccatatccgcatgaacataacaagtcaattcaacattcatgaagcacctattgttttcaggcttgggtgctgctatggcaaatgtaaatattccctgccctgacgatcacatagtgttatagcctgaatgcttgtgcgccccagaattcctatgttgaaactctaatcctcagtgcaatggtagttgaaggtaaggccatggagaggtaattaggtttagatgaggtcatgaggataggaacccatgatcagattagtatccttataagaggagggagatcagagcactttctctgccacatgaggacatggtgagaaggtagctgactgcaagccagaaagagagcccttgccaggaactgaatctgccaaccccatgatcttgggcttctcagcctccagaactgtgagaaataaatttctgtcctttaagccactcagtctatagtattttattgcggcaatccaagtagactaagaaattactaccaagaagtgggtgctgctgtaacaaataatgtggaatcagctttggaaacggatgatgtacagataatggagaagtttcagatgcatgctaacaatatggacatgaaatgtgattctgatgaggactcagatggaaaagagaggctgggcatggtggcttacgcctgtaatcccaacactttgggaggccgaggcaggtggatcacctgaggtcaggaggtcgagaccagcctggccaacatggtgaaaccctgtctctactaaaaatacaaaaattagccaggcatggtggtgggcacctgtaatcccagctactcaagaggttgaggccggagaattgcttgaacccaggaggcagaggttgcagtgagccgagctcgcgtcattgcactccacctgggcaactgagtaagactcctttgcaaaaaaaaaaaaaaaaaaaaaaaaatagaaaagaggagagctgtacagaaagcatccatcttcttagagaatatatacataattatgaacagaatgttggtagaaatatggaaggtaaaggtcattctagtgaggtcgcagacagaagtgaggaaaatgacatcgcacaatgcagaaagtgttatctttgttatacagcagcaaaggatttgcctgacttatgttgacgttccagtgttttgtggaaggtacaacctgcaagtgatgacattaagtacttagctgaagcaatttctaagtagtgttgaagaagcagtttggtttctcctgattggttgtagtaaaatgcaagaagagagaaatgacttgaagactgaattattaagcaaaaaggaaccagagccaaaagattttgagattctcagtctatgttgcaaaaaataagaaaacatgttcagaagagaacaagggtatggctgacctaccatttgataaggagattagtgtgggtgtggagcatggacctaaccagccatctcaacagagatggccaggaacagaaatgggatgatacc

SEQ ID NO: 1128 - DNA, 1634 bp, Homo sapiens
tggtggcgcatgcctgtaatctcagctactcaggaggctgaggcagaagaatcgcctgaacccgggaggcggaggttgcagtgagccgagatcaagccactgcactccagcctgggcgacagagtgagactctatctcaaaaacaaacaaacaaacaaacaaacaaacaaaaaaccataagattccaaccttttgggctcagcaattacactcccagaagtcatgcctcaaatgcacttttctgtcttctaggtcttttctcctctctgtcctaatctcctctccatgcctcaagtgatgccaataaatgggtaataattcccttaaactccgtggaattaatttctttttgactacaggaattcacagttcaaaacaaaataaccccagattccttaataaatagaaaccttaaagttccttctaaaaagattcacggctataaaagtaataaatgaatcgcccaaaatatcgcgctgtgggtcgggttaataaccctattggacaggagctggcattactcggtttgggcggccgagcccagacatcagcatatgtgctaccgtagtaccctcttctggccgaatacaaaatcaagtttatggggccgcttttagtcaagttttccatagctgcttacaagcaccgagtttcctgcgacttcctgtttatcgcctctgctctcctcaagttctcagctttttcttgcatcagctaggcttgcctcctcctcctcagggaagatcaggatcccctgatattcctaatctcagctcccaagatttgccccttgcactaccctgtttcctggctgtttgcaccatagcctcccaccttgagtaagtctagttccatctgttctctcttatctatctgcctccgtactggccatttaccatatgcccacattgcatctgggcctctgcactcatgacctacctgccgttccctcactcactgccccatctcacctgcacttgcctgagcactctccgttgattccttgatccagggttttataaaatgaggtctgtggacaatctacattctctccacctggctgcttgctacctgagctccctgaatcagaccttctggaatcctggaacccgcatttataataaataccctgaataatttttatgtacatgcacacacatacacacaaacacacacacaacataaaaaccaccctgggctgggcacagtggctcacgcctgtaatcccagcactttgggagaccgaggcgggtggaccatgaggtcaggagatcgagaccatcctggctaacacggtgaaaccccgtctctactaaaaatacaaaaaattagccgggcgtggtggcgggcgcctgtggtcccagctactcaggaggctgaggcaggagaatggcgtgaacccgggaggtgaagcttgcagtgagctgagatcgcgccactgcactccagcctgggcgacagagcgagactctgtctcaaaaaacaacaacaacaacaacaacaacaaacaccctgatgtttttgtttgtttgttttactaagccatattatcttgtctagaaacttgccatggctccaagccatctaaagatttaaatgcaaaagactcagattggctttcaaggcttttggta

SEQ ID NO: 1129 - DNA, 2111 bp, Homo sapiens
tacagtttcacatggctggggaggtctcagaatcagggcaggaggtgaaatgcacttcttatatggtggtggcaagagaaaaatgaggaagatgcaagagcagaaacccttgataaaaccatcagatcttgtgagacttattcactaccatgagaacagtatgggggaaactgcccccatgattcaaattatctcccacagggtccctcccacaacatgtgggaattatgggagtacaattcaaggtgagatttgggtggggacacagccaaaccatatcacctggttatctgaattctgatcaagggcacttcaggaatttgggaaattttcaggtactgttgttctcaaacgtagctacatattgaaataacctagagaattaaaaaacagaaactcacttatgcctgagtgctataccctcctctgcttacaagtatgttcagttcatatggggtatggcctgagcataacaatgtctgaagcttcataaatgactggtgtgtggtcaagttgcagaaccactgtgctagaacatcctgatgataaagatctgactgtcagttcagatacaatctaaatatagagaaattcttaacagaggatgcagagtaaatgacttcaggtggaaagcacgtaaagtaaatgtgagaagaaggtcaggtggtgagtgtggggagctggggaaagcatgctcctgggctccctccaacagaagccacctgtagcctgggaccagtgtgctagaggaacctgttttcaaagaaagccagaagtatggatgcatttttatttgcagcctgatgatttttatattttggcaactaattcactttattaaaaaatactgaataagctcaagaaatctgtgagctggattcagccaaagcgaatgccagtttatgactttcctcttggaaagaaaagtctttcatgttgatgtatcacattttcgccagcttttctggggttatgttctcagaagtttcgtttagtttgctctcatgaaaggtgacggtaatgttcctcagctacttataaacatttgaagaaacttttcctctgtattcttagttttatactcagtgaaaatataagtcaagtattcataggtatttcactgttagatcaccatattgaggaatgagtgttagttcattaatgccgtacacaaacacccaaaccaaaatgtgcagtgcttgtggaatcacgatgagataattagcaatttcttcacttcccactgagcaggatgagttgaggattagcttctctcagtagattacacattagagagaaaaatgtcaaacagcaaagtaaaatgggactctacgtcttcccacacaagcatctccagtgcactaatgagctagcttccttgtcacattcacaactagcagcagatgacctaagaataagtcagagaagctttctattagaggaactttatcttgcctctaaatatatagtaaaaaagtgggtcaattggtacttacagaagatattttagttcaactggagaaacttaactattttagaaataaagaacccctggaaaagttagtctcccttattatgcatggaaataaaagcactttcttaatttgaaataagtgaattttttactgaagaaattcctttatgctgtcctcagtccacatattaaccccatgtatcaaggcctctgatctgccatctcaaccaccttgtcactgtccactaacctcttgctgcttcccttctctccttgttccacctagggttcacagtctctgctttgaatcagacattcacaggatcagacatgtgattcagggacttagcaagagggagtgatcagtgcattggcctctgttttatgacaaaccaccaaaggacatgtgtcctcacacaacaggtacacttgctttggcatacagaacctccccagatggctgtgctggaggtgagtagatggcgtgaaggaatgcctctgcacatatttgtcatttcctgtttcccattgatcaaaatctctccaaagagcacactgtctctccttctttatacttatggactatgacacttggccacactgagaactgcaagggtaatcagatcccatacactgc

SEQ ID NO: 1130 - DNA, 1184 bp, Homo sapiens
gctgctgcataaaataaggtatatgtgtacacacatgaatatgaaagagttgtccaaaatgtattacaggcccacaacaatttatacaaaattctgaaatccataaagctcagaaaactaaaagcttttctttcttttatctttatttttatttttgtattggcaatagaagtagctcaccctacctgaactcatttatgctgaaaattgactgcaaatgatgtgaagtatttatcatcttaagtttttccacttaggtaactaatattttttgtgttttatttttttgtataggaaggtatactataatatatattatgtatacactgtattcccactcttaactcatatatatgaaatatttctggtcccaagagttttgtattaaaaattgcatctctgtgttatttaattatataatttaaaaacattataatccaagtcagagcaaggagtgtagtcaaaatatctaaattcatttcaaaaagagaaaaactattattattgttattatttatatacaccttatatctagcaccagatcatcgttaaatttcaattgggttgacaacatcaaactctgcctcaccttgttataatcaattatgactctgatgaagcagtttgaataaacaagtctgttgtgactgtcatatcttgttaaaggaagataaaaacaagagagttgggggagaccactgcatatggtcacgatattgtaaaaccaagtgctaactggaaacgagaccagcctacaaggctatgcttgagccatctgtttacagtctggtgctccacagcttgcaaggttgttaatctatcaatttaaaagctacatatgtatttttatatcatttcaaattgctaaaaaatggcattaatataggaaagtatctggaatgattgtttgcagactctgactcctctcaagtactcaggggaatgtacttaaattgctttcagtctattttatatttttcatagcacctagtacaatgttatttactcagatagttgtcatcagcaaacccttattggatatattaaagcccagaggccctcttctacacttcctggggtctttaaagttatacatagactataataatatataatgttccccttattcatctcttagccatgaccacatgagcaaactgctatctcatttttctaaggtggct

SEQ ID NO: 1131 - DNA, 3116 bp, Homo sapiens
agaattctttcacgaagttcgtttgtttttctcacgctacaaaataaaatggatttaaaaatcacatcaccataatctatccatctacaagtataactctaaagctgtaagtgacataatgttttaggatgattcttccatgattttttaaaaacaaatatgaagtttctaacactgagaagctttttggacagactcactgtccaaatgaacagactcactgaatttaaaagttctggattcacctacgtcctgaatgttcttgctgtcatcacctaaacaaatccatccttttttttctttttcctgttttctcccttaacaaaggagctaatgaacagggtgaatgctctcctaggggtaggaaactaaattggttccacagggcttcggaagagatatactgggatttgaatccagtcctgctctacaccagccataaagacagggcagattgtttaatgtttccaaacctcagttatctcatctgaaaagtgaaatactcacaaagttgtgaaaattaaaagaaatctatgtaaaatatcagtcacatagtaaacaatttactgcatgggtatttcgtgctgaaaacttggcccccgtgctaatggtaatgatttgttctctcatacagggcatgaaggacctcacatgataccagactgagagacctagtctttaaaaaaataaaatgatgacaagaaacaaaaagtaccttaggtaccaaagctcaattatcaaaccagagtactcagtaagatttgagacttaagaaaaaaatctcaatcccaggctttcatcaagcacttcaataaacaaagcagaagtattttacctgtccaattacgtggtaataaaggaattttcttaaattgagacgatgtattttcacggcacattaaatgctagatgtctgcacctcaatgacttttgtactgagggaaacaaaggtgaagagagttagaattcattaagggctgaagattaattaggccacctcaaccccatgagtcacagccatcaatttaagagacgtaacagcatacactggattttaattaggagggttacaaaactgtttaagaaccaaagcccaattgtcaagcccaattaagcaggctgatggaacatactatgtggtgctataaagtgttccttttgcaaaagaagtgtaaaataaaatccttgttcaagagctcactggcttccccacatactatatactatagtaagtgtatacggaataaaattcattcatttattgtgcaaaggatgtcagtctttgagacaacaagaaattaatctggaattagcccaagatcaatgcaaaaataagtcaaacaaccctagaggccgggcgcagtggctgccacctggaatcccagcactttgggaggccgagccaggtggatcacttgaggtcagcagttcaagatcagcctggccaacgtggtgaaaccccatctgtaccaaaaaatacaaaaattagccgagagtgatggtgcatgtctgtaatcccatgtactcagggggctgaggcaggagaatcgcttgaaccccagaggtggaggttgcagtgagccaagatggctccactgcactccagcctgggtgacagagcgagactctgcctcaaaaaaaaccagccctaggacaggagcaagatgtggatggtggttctgggtttgactaaccaatctctccaggcggggcttcatgagataacctctggggctcaattcagtccctggaccctctaatgaagacctaaacttcctgaccatcacagacgcaggtgccaagaacaacagaatcagggcaggagggcactgaagggagagtcacagacacatggggcaaatccgacggaaaaggatttgtagtccaatatatacatttgcttcctgaggcaccatttctggttaaccttgatcttccttttttttcttttttaaaccaagcttctatcacccaaagtagctacttgatgaataactcaacaagctcctttcccttaaaaggccaactaatttttttttaattaactagaatatacataacacagaaacaattttcacatcttcttcataagtgtctacatgcaaatagccttagcaacacatcatgcttatctctttcagaacatatctaaaattctccactttactttggtgagagaaattgaatgtcaacatttatgttcattccagaactgggtccacttccttccaaatgtaaaatagcagctgccaccccactctggctgcattgctgcactgcccttcccccaaacaaaccaccagcaattcccccacttacaggagctgggaacattcttcatgctctttatgggggcgggggggagatgaattttatgaggttgatgagaaaacaagttcaaaagtcaagtcagctcattttgaggggaggatctcctacctttagtttccccatactttccccttgcccatgtcagcatatgcatatacacatgtacaataatgataccagagtgaccaaagaacacaactttacaagaagcagcagaaccaaaaaggcaactacccttccatctccctcctgcccttgaaccactgattctccatgttaaatattccatcgttcaaaatatggctacacatattgaagactttgtccttcctaacggtgtcataaagctgaagggtttccttgtcaccatgagtgcgcatagaagtatcaacagcactgcaaccagcactgcttgggttcacacacacggcagagaaccatgagagagcacaaggtatgcaagagtttaaaactttcagtttcctagaaaccacagtcatgtcaaaaagggaagacaagaagatcgccatgtgctatgggaagatgcctaattagaaaggaactaaaagagaggacaaaggctgggaaggggagtaagttttgcaaaattgttttctcatcaacttcaaaaaaggcaacccaaatcccccaaagagcataaggaatgttcccagctcctgtaggtgggggaaggtcagtatggtaggtgcacctaatagcaataacttaagaaatgacagctgccatgcgggggccgctgctaagtgcaagtgctctacaaaccg

SEQ ID NO: 1132 - DNA, 5075 bp, Homo sapiens
agaaagcagcaagaagttatctgatataacttgaaaaggcaaaaaatacagaccctcaggaggtcatttttgcataggaatggccctacaaaaagaccagttccaccctagatccagccaccagcactcctaaccaaggaagtaagcccccagtctgaactgtcgttaaagcacgtctgctctgaactcaggctgaaggtgctgtgtgaccgtgtcacccagcattccccatcaggtgcccatctcctataaagtcccctttgaaaacagaacattagccttagattttagtgttctgctagtatcattcacaaataccatggctagccttgcacggtgcttggcctttgtaggtacggtccacacattcctaagtgaaaattatagtcaacttaggatcatgagatgttaaaatacagtgaaccattgtgttccaaatattatataatttgaagaaactactatgcccttgaaactaggaattctttgattcttaatattaagtaattcaacccagttattaatccagtctttttttctagttccctttgtttcagtttggcagtttttactgtacttaagtggagaaattttagctgttttttataaagatgccttgcctttgctttaaacacaataactgcccagggcctatatttttggccacatctttattttcagagggaaaaaaggacttttcttcaaatgtattttcccaagacaatatggctgtcattgttaattaaaatggttctctagtatgtaacatgattcttgtgttttcctcattgtgttgaacattttccagttgaaacctaatgagcttttcttttagtaagtgctgatatatgtgagtgcttagggtaatttttcttttattccaaaagtattttttgctgttgttgtacttaaacttgaaagctggatgaagtatggttgttccccagtttggttataaaatgaatgtctgctaggccacaaagtatggaggacagatgggaacatcttgtcactaaaaaagatatgttgaactcatttgttcaaaataattaaatagtgtttctaagctaggaaacatgagtttcaagttattgagcctcctgaaaacatcattttttaaaactatagacattgaagatattgcacaaatctggaggcctgctttttaatgtacgtaccagatgtccccaactgtcacacttctattaccctcttaaataccaaaaagtagcctttgttcttcggtaataatagactttgttcatatgactgctacatgtacatttcttccaatttagtaagtgattattcatccatatagctaagtaaaatatttccactgtttattgtgaaatgtttggatgccagcaatggattccagacactgcagaacatgaaatgaagtgtattgttttcctgatcattagctccatatttttaattcgatgataaattaataagaaaataatagttgtaactaaggaagggtagatgggccaggctaaggtttaacaaagggcagaacagtctggcaagaattagtcttatatactataaaaagcaggagcttagtggacatgccttttggacgattacttgccgttacaggatgaaaacagtttacgaagcatgtccccttagcctaattaatatgccttcaaaacaggtcatttatgctctggtccagagaggagtcagtcctactgttatgggccactagggctgttagaagctatgtgggtcatttttagaaatctagcaacatctcctcccaattcccagcccaaatcagtaaggatccatgtcacttggtccactttataaaacatagctgggtgcagtggctcacacctgtaatccccacactttgggaggccaaggaaggcaaatcactcgaggtcaggagttcaagaccagccaggccaacatggtgaaaccccatctctactaaaaatacaaaaattagccaggtgtggtggcacatgcctgtaatccagctactagagagtctgaggcaggaaaatcgcttgagcctgaaaggcggatgttgcagcgagtcgacatcgcgccactgcactccagcctgggcgacagagactctgtctcaaaaaaataaatgaaacaatcacaacagaaacattcccttattcactgaacatttcaaaccctgaaaatgtgtaatgagaaatgacaaatttttaaaagtttaattactaagaagacaaaaaatgtctattatgaatagaccaattctcaattggtagagaactttgaactggaaagaaccctaaagaaatctcctgtctacccctgttattacagattagaaaccgaagtccaggaaggttgagcaggcaagtctccaggctgagttcctgatgtccaggctggaggtgtttcttccctgacccttcccctgcctaccctggccactgagaagggctgaacaggagctaaatctggagggtacaaatgttatttcccttgttctttaagattaccaccaaaaagggaaaagaaaaaaagccccacaataaactactctctgaattttacccaggaccatagagaaatatccctgaatttcaccactagcactataatatcaaactagtgatcaagtataatcataaagcttcagtttgcttaggaagtctatgaaacgtgattttaggtcttgcgtctatttcaagatttatagttttgagtatgaaaagattcaaccctctaagtggaatatgaccctgtattttgagtgtaggcttccgagtgccaagcacaaggaggcagtcaagtagggagtctcagaaggtcacttataagacttgggtattcaaacatcagtcagagtggaacttctcagcaaaagagaggccctgtaataacatgctccctcagttgactagacgtcctacaaatgcaagaaaggtgggaatatggagaccccaggccaggtcctgcaaatgctttgcagtttctgagtatgatgctctatagcttgcagctggaggcacctttgtctctaagcttctgccagcaccagacaactgggttgaagatctagtgcagttacagatgagcaagtgtgttcctggaacatgtaggtcagctgtggagtatatgacttcagtgacagtttcttgggcaaatctctatgatagtgtaactgtgacagtataaatgacctaattctgtgtcacactgaaataacctgcagaacaagggtggccagggccgctgcccccactgccgtttctgccccagaaggattctctaatttcctttcatgtgacctgttcccttttattagctctgcttcaacagaaggagccactctgtgtgtcccatatgggcaattctcagtcagcatttctgaattgtaagcttatttattttctgtagaaatgcctttccagggaacatagaactgtataactacattatgtcattaatcctcaaaacatatccaagaagtggtaaaattacctagaataaagaagaatacattaaaatgcaaatatgattctgtaaatggatctctaaaagttggtagatcttttcaaaggtgctgtgatccacctttatgcctgcaaaatcgcagagactcgggctaacccttatattctctaaaggcactaaagatctatcttgtcccaactggggacaaatttcagcagcaggaatggtcaccttcaactggaatatgcaggctggggcccctgtgtgcagcctctgtgaccagcccagttccttacttccacacagctccctcctaggaagcatcttgccctcagaccacctgagcacccacttcccactgcgctgaaagctgagatggtggtgttccgagcacagctggacctgagtgagctcccccgtgccccatgaggattatgcatctgctgtgcaggaaatcccagagaacacaggggtgagcaaggcaggcctgtccaccacctgcagtgctctgtgccaggcagcagggagtgcagcaactggcctctcatgctttggggcaggaaggagaaagcctcaagccacacctatagaccaggagcctcactgcatggaggggtcactgcacaggtttcaggaactctgctcagatagtggcatcttagaaactctgggaatggctatataccaccacaacttgttttcctcagcatttatccagagaaaggtatttttctataactgaggatagtagttttatccctgtctcgtaattgttttcccactatttcagtttcacttagatttcgtaatttgttgacagccttcagccctgttagaaagcttgggcaattgattagcccagcagacagttttatggcactgattctccccaccacccccttgacttcctcatttctgttaacagtgccatattttcacacgtattcaaactcctggcttacctgtgacaccaccctcagtttgcatctggctccaaattctcactacaggcacttcccttcccttttggcctcctccctcctccatcctgtcctgtgaaataggctctgcccctcctagcccattggcctcaccccctccctgggataacacctgtgcctgcagttcaggttttcccacctgcctgtccaaatcagtagcttctgtgacctcctgccagccagctccagcatgtgccgtcacctcttctgcttctttcccaggctatatatagttggcctgaagagctctgcaccccaaacctgcttctttctggcctctgtccttgacactgcaactcaaatgtggtctcccatcctcctgtcaaacacaagttcacacactttgaaaaacatccaaggagaagcggcatggtctcgagtgagtgtgagctttggagccaggttgacttgtttccttccagctctgtggctccagacacatcaccactgtcaaaccccagtgtccccggcaatgacacattacctgctgcttggtgtttttgtgatgatgtgtgttgagctcctggcacacaggatattcaagccatacctgttgctcttcctgccctttgtcacaactgcctggtggtgtaactgtttgtggtaaggcccccc

SEQ ID NO: 1133 - DNA, 2135 bp, Homo sapiens
gaataccattttgtgattgtcaagaactgtgaaggctgtgagattttaccccattgattagctaacaagttagcctgccatagattcatggaagctggctgatgacataagactcttgggtcaaagacaatggactttattactgatggcacagcaagcagcatgagtaccatatttttcccttgtccccaggtcctacagaagcaatgcagattgagatgaaggcctgcacgagcagtggtttgcatttcaggaaaaggactttgaatttagggaacttgaatcttttatactggacagccagcatgccctgcctttgcaccaaagggagacactatctctgtcttcaaagactgtttgctgtacaaacttcatcaaagacattcttgggcaacagatagtcgatgtctctgctcctaagatatgcagaaatgtgacagatgcgtggaaaagttctcccagcagtgctaagcctgctgtagcactttaaaaagctaaagaagtaagacctcagccctccagaattcagtggaagatcaactagctgatgtggaactacaagcaaaacatttcacttttcagtgcttttctttctgtgattacaaaataggaatgatatctgcccactcactgcttattttgagaaataaaggaaaaagaacagtctgacaaatgctttgagtttcatgatggacactaaaataggagaacatcatataaagacatactgggtcctaatcacacttttattctccaatgactttggggaaagtatgacaaatttacatatattttattctgataaggtggaaatactgtggttttttttttgtaagtgctgaacatgagtttaagcccttagttttgtcaaactataaagctgactaaatatgtttaaacactatttttattgaaactgctgtttagatttcttaagaaatcaaataggtttgctgtctctttatcacatcactttgtagctggagaacagtacggatctatgattcgtgagtcctcacatcttctccagacctctcatcatctcaaacatgcagctggcaagtcttctaccctttctgtcttccacctcaggggtaggagctctcttcttcgttctcctggccttaacttcctctttgctgcctggtgagtttttacataaagtcaaactagactttctgcttgtaggcacaagaatcattagattttacaagctgccttaaaaagtactcctaaatgcaattaaagattttccagcattctgtggttaatttgactaacgttgtgctaaatgatatcctaaatttccgtaaagacagtgcttacctacctgtgctatataaccccctacatgagaatgcctcagccagtacccaagatctagttaatcagagcatctgaagatagagctcagaaatacgcattttaacaagtaccacaggtgattcttgttagccactaaggtttgagaacagctcctttgaaattatcaccaatagaatttcaataattatgttattttacaaattgtcccataaaatacaagacacaagcataagccatttattaaaaggcaaacaagcaagagatataatatatacttttagttaaataggataatttctaaagaacaagtatatcttaatgatacacatagtttaatttcctttattaaaaggcaagaagtctaaaagaattgttgaattaaatatccaacaatagaaaaacagttaaagtacaatacatcaactcaatggaatatttttcagcttttataaattatcactaaaaaaaattaagcaatacaaaaatatgcattagaaaatagaaaaaaatgtacagcacaaaattgcatgtacatgattgcaactaaatatcttctgtatttgaaaaaaaaactacaagagaaaatgtcagagttgtcagattatgggaaagtcctctccctcaatttttttaaagaaatatattcaacattgtattttttctacaattaagctaaatagatagactgtgacagagcttggaaatcctaattgcaggctctgcctaacagttctactaattaaattaacaacacctattttgcaagtattatgaaacaagagaataggtgaaggcgactcattctgttt

SEQ ID NO: 1134 - DNA, 1678 bp, Homo sapiens
actattaactttatgattttatgaccagtatatatttattagaacatttacaagtacaaaattaccttacttatccatttaagttatttgtgttgagatatgttttctctctaataacattggaaaacctaaatttttgtttgtatttgttgatatatttttgtccattttttatttttaattttggcaatctgttctatgcttctttcaaataaacatctgttcaacttttgctttgtgatctaatttggtactttgtgttggttaattataaattaaccaattcaaaatttattattttaaatatcagataatatttgatttttcttctcataacttgttttgtggtttctacttttcttatatttttcttgattttcccataggggtatatcaactgcagtttttcccatctttattttttcttcttctattttttctagctttttggaatgcatgtattgccttatttcattccattattttaaaagaaaccatcagcctcataaatgaaactatctattaactacccttacataagataaaaatattgttttttctttcccttccaactattttccagtttaaaaaaatgtacatgatttggtattcacgttaatttaaaaatgttctccataagcgtattattttataaccttactaaccacgattattaaaatatggctctatggtttaactccatatcctaacaattattaaaatatggctctatggtttaactccatatcctaacaattattaaaatatggctctatggtttaaccccatatcctaactaaggatgttaccattattaccatgtattaccatttcttctagcatcttctgtagagctgaagtgtatcttagagtcacctcttcatgaaggagatattgatgatatattttctcagctgctggtagatgaaaatatttctgtaatgccctcatgtaataatgataatttcagttgatacgcaaatatttttcttaaaaatatattttgttcttttatcctcagacatctaatatgcagaagataagatacagccagatttttcttccccgcccaccccccttggaaacaaaccattttcccctaccagaaacttgatggatgtttttctttatcctttgaccttctctagctcaacaggaaatgttttcatttggggctcttttcttttttttttttttttttttggtgatggagtctctcgctctgtcgcccaggctggagtgcagtggcgcagtctcggctcactacaacctccgcctcccgggttcaaacaattctcctgttttagcctcctgagtagctgggactacaggcacctgcccccacggccgactaattatgtatttttagtagagatgggatttcaccttgttggtcaggctgatcgcaaactcctgacctcaggtgatccacccacctcggcctcccaaagtgctgggattacaggggtgagccactgcacctggcctattttctttaatgtaaatactattccataatcctgtttgatttacagactctttttgttaaaagatttcatttgttcttgagattagaattcgttgcaacaactgtggtagccttagtttttccttttcaatttactatctttaatgatagcatcctcagggcttttgcaccatgtatatctttacattc

SEQ ID NO: 1135 - DNA, 2961 bp, Homo sapiens
gggtgtaactgtaccaccaagttaaggacttaacaagactgtgggggtaatgtgttttccatacctaagaataactaatgaaaaagatacacccaacaatttccttcataatggtttcttcaatgactgtcctttacctaaaccgttgacttctgacaagtttttaagactagcttatctttcctgacctcttgagtaaaaatttaataaaggatgtcaggctggacaaagacaagttctcactcttcagaagtgtatatacagtgcatcctgcaaacaacctgctatttgcctcttcacagtaaagtgacagacgtgcttttcagaaaggaggtacaaaaaaacaaagcaaaacaaaaacctaaaaaacagtgcccctgcgactggagagaggaaagaagctctgaaggaaaagataagagggccctttccccgatgggtaacatataggagagctttcctctatgtctgaggcaaaataaaataaccattgattctctgtcaactttaatttaagaaaattacttggtttaagaagaagtcgagttgctgaatgttcatttgaaaaataaaaggatggtaaaggttaacagttataagcctttttggcaaatacacagaattcaagagatgggtcagaggagctaagatgttgggtagtctctctcccctaaagaacctggcacaggtctgccaacataagtacattcccaataaatattcatgaagttgaactgaatcaagggatacaatagtcgtccttacctgatgcatggcagtatattaaatgtaagtatacttgacaacatttctaggtacggaagtcagcaaccttaacccttaataaacactcaagtaacaccagcaaaaagaaaaaaaaaaaagagtttctgggctgagagcatttgaggtgctttgcaggtcagagctatgctcaatagaggaaatatcgcattaggacaaaatctaagaaaggtaaagggctctgttccattgaagagacttccggctacgaaactattcctcctgagcagtgagccaacagtcaacatttgggatggtgggttcagctcagacaagactcaatatatagaagctgtggcctactctggccttggtatatgtagcagagctctggatggctacaaaagctttacatttatggctctaaaacgctgttcctgagccacctgtgcactgagtttcaggctgttctgaagtgtacaatacacttattttatttgaacagagaaggcaggggagcataactccttgtaacagcctcttttctgactcctttcctatcctttcatcaagaggagtcaaaggagagcacaaagtacttggttgcttaggccgactcagcctgtcctaccttggtttctggagataacattctggagtttaaatacggattgtaacactgacgagctatgagaccttggggcaatttacttaactttccaagtctttctctcttcatctataaaataaggtagtgacacgaactacttcatggcataactatgaggagaaggcatggacagtgccttctgcaagcactcagtattagtgaaaaaacatcaacagcaatatgtataatctttaggtgttgtgttttacaagtccaatcttagtccctgccctgagatcttttctgtctcatcccttcacctatcctaaacaagagtgtaggtatcaaatcctccactgagtcctacagcagctgctaacaatgaacccaacatacataacaagatttgggggaggcaggcccctgcatgtcctcaagcggcccagcattgcttgagtaaacaggccctgaccatgtggaggtggagactgacactctggcttggggtttgaaacaaagagactgggattgacttaccttgataattgtcagggagtgaaacaagcccatgagaatctgagaagttttctgataatccagctaataattgttgcccttataaataaatttaaagtaatggctttgtttggtgaaatcaaagagccaagttcatgtgaagttagaagatatagaagactgaaacatgcttaaagtgtgtgatcctgtcaaatcagaggaagtctctgacgaaaaaagggatggaagaaaagcacccattttgccagtggctggccaccattgctggtaactctcttcctctgcaccagaagacagagcacacatggcactgatgttacacactctccagcattcaggaactcactggactaagggatacctgaaggaccagtgctccaaacacagggtgctatttaattgtggctctcatcattgctgttattatggatcggtcacgcagaaacgctcctggcaaccagtgacagcacagagcattatgaagatggccctgccatgttttgtattctgaacattaaaaaccagtttggctcaacaaacgagcagcgggtgccatgctaattatataacttcttagagcactaataggatttcccactgagccaactgggagaaaaaaaccataatactcatttttatctgcatctcagcaatagtgacctccttcagcctgttgatgtggtcattaataaaacatttaaaaatgacctgaacagagaagtgaaaaggctttttacaaaaatagagcttgtatctgactgccaaaccgccatgtatttgaaagacttggaaccaatatcaaagttggtcgttaatgatttgaggttggcctgggaacctcctgtatccagaagggttgttcatgcttttgactggttatgaatgaaaaaagatttctgcctttgaggggttttaaaagatggaaataaggatgtttgtgatggtgctcttgctttgcttgggacataaaagatgattcaatttcacttcagcacctgacacgtcatcaccaacatgcttgcttacaagttcctttcaattttagaataataattaaaaacaaatatata

SEQ ID NO: 1136 - DNA, 1648 bp, Homo sapiens
gaaccatttcactggtgctgcaacttgggttatacggcatacacaccaacctgaaaataacctgagtggctgtgaatccagggatagctagcggttaagatccaaaaagactacacagcctccaggttcccaaactcatcctctttccaaaaatgctgtgttttttgaaatgcattactatatacatgaagaacaaaatattttggaagaacattgcacatataagcaattaaggatcaagctcatttttcatgtttacttcagttaacactttattagttgccatatacaaaaggccatgtggtaggcatcaaattgcctaaggaagcgcatgcaagcaacatcctgctgactgagcaaaggcagagaaatcaggaagcctaatgacgcatactagaccatgggtattggcaatctaaaaacctaagacaacaaagcacacccttctattgccacctcactctcttgcagaacctgacaattatgcttatttccccaggattctgctcaacctatttgaacaaaacaaaacagcaccagaccattcttaacacactttgtagcacttatgagacctgtgagattgctaggaacacagcttgataatcagcagccatgctagtgtctagattataatcagtcttcctcattatttcaaattgttttgagctagggtagagatgtaatccatagggcaagctttcccaaatgtctttgtggttggaaaagcaaaacttttaaaaggacaggatgactgaagtgagcctctgagaccaaagtaatttgcttaaaaaatttactaagatgtaattaaacaaagcactgtagcagatgaacatgatgtgaatgcaacagccatggtccaaggattcagagaaacttcgtgtggaaagggagcttccagacaatctagtccaacctcttcattttacagatgaggagatggaggcccagaacgtgacccaagatcacacagtaatgaaggcaaagcaaggcaagaaacaaagccttagactcccactcaaatgtgactctccttatgccactgaacgataaccaccagcaagaagttatctaaaactgtcctttgaagactgaaagactatgatgtgaagaaagcctactttttataatagacactatttagttgcatcacaggagcttcagtaaaaccaagggaaacaacacagaacttaaatttaaatatttaagtttagtatacatgtcagatcaatgcgaagtcataaaaaatgcatgctaggggttggctttgatttgagggccttaccatctagaacctgtaaaagtaatcctgaccagttggtctagaagatttgagctccaacatagaaagtcagcaagaaagtacaaagtactttttcataattgcaaatagttatgctcatttttttttaaaaaaagcttttttctccaacccctaccccccaaatttttctttttaactaatttatctttgaaatagtacttagtaaaacctcttttgggcttggcatcagatatttcttccgcttgcattttgagttgctctaaaagtcttttctaatgacggtgattttaatggtgcttatagatgttggcaaagtactatagaaaaaatgccaaaatgcacttcagcatttgcagaaca

SEQ ID NO: 1137 - DNA, 1874 bp, Homo sapiens
gttaaggatgtttgtgtctatgttcatagcaatttttttcttatagtatttttattagattttggtatcaggattatgctggcttcataaaatggttggggattgtcccatcctccttcattttctgaagaagtcatgtaggattgatattattttttccataaatatttgatagaataccatgaaaccatttgtactagagttttctttatgaggattttgataacacattcaattgctttaatagatatggcactattaaagatttttaatttcatcttgtgtcaattttggtaaattgtattcttgaaggaatttgtctgttttatctaagcattcaaatgtattgacatagagttgtttattatagttatcatcttttcagtgtatcaggatttgcagatacactgcaaagaaccaacttttgtttatttttaatgtttttgttgactttctgttttctatttcattgatttctgacttaaaaaaattccttcgttccttctctttactttgggtttaatttgttctttttttttctagcttctaaagatggaaacttgggtcatcgcttttatacctttcttcctttctactataaacatttaaagctataaatttcctctaagcactgctttgttttctacaaattttgatatgttacattttcattatcattcagttcaaaatactgtgtatttcccctatgatttcttctttggcccatgggttctttagaactgtgttgtcagtttccaaatattttgtttcctacatatcttgttggtattgatttttggtttaattaaattgtggtccgaaaacatattttttaggatttcagtcttttgaaatttgtttagacttatttatagcacactagggttttcgctcagtaccttttaataacttatatttcactgttgagatttctttatatttaccaaggtattcctatcttggtaaatctatcatgcacacttgaaaagaatgtgcattctgcagctgttgggtgtagtattttttaaatgtcaattaggtcaatgtagttggtagtgatgttcaggtcttatatgtccccactgattttttcatcttattctaactattattgagagaacagtattagaatctccaagtatttgtctttttcttcaataatttttttaattttttgctttttaacattttgttattaggcatgtatgcatttattatttttatttcttttaggtgaattaccctttttatcattataaaattcatctcttttgtctggtgatactctattgccttcaaatctaattcataggatattaatatagttactgtggttttcttatgctttctgttttcatggtgtatatttttccaagcttttattttctaactatctgtttctttgtatataaaaggtataaagaacatatagatgaattttgctttttttatccattctgacaatttctgtttttaattggagtgtttagtccatttacatttaatgtagttatttatatgattggatttaggtttaccattttgctatttttgttgttgttgttgttccatatgcttttttattcctctctcttcctttcttgccttattttggattaattaatttttttatagaattctacattagtttggttccctaggaagcagataccaagattgagttataagtacaagagctttattggatgcaaggccaacaaaaatagagaggtgaaagagagagtttgttacctgtgaaaggggcagaaggaatgaggatgaaagagaaagagcctcagactgcagcacagttttgagaatgtctctgcaagcccgatggagagtattaatgcaaaaattgcttgtaaacaagt

SEQ ID NO: 1138 - DNA, 1388 bp, Homo sapiens
catcattagtggcagaggaagtacatgaccaaaggtgcagagacataaagcatccaggtctgctgagggcactgcaaatagctcagtatgtctagaacatgggaaccaagctgggcttcacagctagaatgaaaggcaatgcaaaataacagaagactttgaacttatcaaaggaatttggacttaaacctataggcactacacaaggtgctaacaaagttctccttctcctttttgcccttcttaatacactagtattttgcaaataacacacttacttgcaagtagatggaagctggattggaaggctataagactgaaggtagaagaccatgtgggaaacttgaacttctgagtgagaaaggataagcatctgaactaagaaggaggcagacagatgtgagaggtggtggactgagtgaatgacagtcccattgggagagagggtatacaaggcaaaggagcagggtttgggaggatgttctcagggatgaggagtgtgggctaactgggcatcccaaaaggggactaatccaattggtgaccatgtatttctttctgcccttttgttgctataatatttatcactttcttcattataaaatacatacctttcattgcagatgatttcagccattctgaaaagcataaggaaaagaaaaaccaccagtgatctcataatacagacattttggaatatttgaaaagatcacaccactgcacttcaacctgggacaaagagcaagactctgactataaaaacaaaaaccaaaaaaaggtgtgcactatgcacatatgtacatttttagaaaattgtttcttaccctatgtagaatgttatagcctgcttttaacatttaatctgcaccatgagcaccgttctgcataataagataatctttggatatatcattttaatgactatatagtgttttatcctatgaatgaaccacctttttttaacctattgattaacattgcaattgacttatgttttgctctcagatataatgctataatgaacattttgcatataatattagacaattttgattatttcctcggtacaaattcctggaaataaaaaatacagtgtcaaatttaagaaaaaacatgccaggcacggtggctcacacctgtgatcccagcactttgggaggctgagacgggtggatcacttaaggccaggagttcgagaccagcctggtcaacacagtaaataaaaccccatctctactaaaaatacaaaaattagctaggcgtggtggcacacacctgtaatctcagctactgcgaagtctgaggcacgagaattgcttgaacccagccagcaatggttgcagtgagccaagatggcaccactgcacttaagcctgggtgacagagtg

SEQ ID NO: 1139 - DNA, 3481 bp, Homo sapiens
ttgcatacctgggataaaccccacttagttgtggtgcttagcgttgttttaattatcattattatagtttaaatgtgtttatggcttttccttctgatttgtaatccagacacctgcaaaatactctagatatatcaaagtgaataaaattacctaacgtcttattcagtcagtgaatgaacaaacccctttgtacccattcaagagtgttgataccatccctgttcctttaaactaaaattactttgggtagcaggtgaaggggatgatgaaaatcatttgatctatttatgattctagttttttactctcttataatgtgattaaattttattgttatagatccttttgctttaaaattaagatagaaaagtcgtttttaaagaaaacttaaaatgtatgcttcatcacccatttaaaaggaagattttatttttaaaatgatgaatacatcaagggaaggcttttatttctcacctgtctgtattttaatataattttattatgaaataaattggtatacttcaagttgcattgatgaatttggtattctaactttaagcctgaaatatttcaagcattctcagatctgtataatggaacctgggcttgtccttcctctatcctcctaggttgccagatcattatgcaagtgtggaatggaagcaaaatcactatgttcaatctcttaaaatggtgaactcgttcatataagttggcaagttgaatattgacaacaaatatagcaaaaaagaaagtcaagttaaaacttgtagcaagtttgctaccacttacccaacaccgaggcttctctcactctcctatctcctggtagatacttaatgctgtcaagtgtaaaactgcctcactccagacttactgtttcaggcttttcagtgggtaaagtcctagttataacctagcactggccctgccactgaatatttatgatagagtagacaaggacaaaataaaaaatgaaaagttcccactaaaacaacaccaccaccaccacacatggatagctatgtgagatgatggatatattaatttgcttctgtataataatcattttactatctgtatcttatcatgttatataccataaatgtacacaataaaaactatttaataacaacagagaaaacaaaaactaaagaaatctggcattttatacaagcagcctgtttaagatctgtgtctgatagtctgccagataaaccaagctttattattcatccaacatatgataaatgacctaccaggcactattactttctttttttttctagcactatcataaagatgaaataatatatgtctttaatagcacatatttctaaaatagatttccatttaataatcttagttaaggcctaaaaaggatttaatgaataatcatacctcaatatacagaaatatgaactagcaaagcacatgtataattctcattgaagagataattgaagagatgtttcccaagcaaaacactgtgtgcatttctagaagtttgctgagatcatggggaaagctgtgattttccagtaacatttgcactatatggcaccaaatctagccatagcagatttgtcagggttattacatgatatggctccaagcatcaccatctactctttcagaaacaagctaaaatgtgtttttgaaccagatttaattgtagcaaagtatgcatgattttgtctcataaagctaacaaggatgctgagaatgcagcatggtctaatgtttgagatggtctttgactgctaagaaaagaacagactctgagcaacatccagtatccatggtaacatgtagcctggcattttcttttcacaaagaggaaattatttccatttatttacactttcaaggatttcatgcattataatatctgcattgaactcaaatctagccttgccctatgttccaaatcgcattttagccattttgtattatgtagtaaattagtttccagattggaaaaaacactctcaatccaagtaacaatgaataatataaaataaaatagaattagtgatataaatgacatatgaccttatttcatcttggatgaaggcaatattgagagttaaaaatcatgttatattgttgcattttggtcattacaacattttggttcatggaattttcaagttcatgtagaattaattcattaaatagttgaccctgttagacaattttttcccatttttatacagagttttaaaatataaattgaaaaaaacatgattcttctttttccttctctgcccccatctaccccttcttgtcctcctcttccttgtcatccccctcctttcctccaccacctcctcctccctctccacagccaaatgcataagtaaatcaggactcttcatccacttgcagatgaatagtaaagggagaaagctagagtgatgatctaacactgctgctggaagaggccagcccactggcctttacttttcaaagtcgaaagggcaactggcattcactgataacaaatcacttgctttcttctcaaacccctagaactgttttcctgtacagagcccagctcagtgatgagcgatctttaattaaaatcctccacatcgtggatccagtggatgtagagagcctttgttaagcaaaatgatctgcatagtcttgttttcctttgacattaaatacaaataaaagcaaaaatctccctatactctgcaaatatgggtagaaaaacaacattcctgctacataaccagactctgacgttttccttttccctccaaactgtatcaatctctgggaccctggggtttcctccattccagggacagacagaatgccctccccaacacttcactgtttgaattgcaactcttcctctgtctccatcaaggggctacaatgtgtaagcccaccccatttcaggctttaacagcttggaattatcatgtgtccatctctggctgtgggagcagacttatataagaactggattgacagtgagtgtcccttttctcactcctcaattctgccactgccatcacctgaccaagtgcatatagacaggtcactctacctctcgaggtcttcattttctatttttagatgacggatatcagaccagatgatctatactgtggatctcactcatcttagggtcctttaagttctaaagtgtctaatattttaataaactgtttctatattccccacatcaaacaataactcccacatctggaaaatcagttgttaaaaatatatatatattaaaaaaccaaatgaactgaccacacaagagcctgcacatgtatgcttatatcagtattattcataagtgcccaaatttggaaacaaccaagatttgctttaataggtgaatagataaacaaactatggtatgtccatgtaatggaatagtattcagtgataagaaataagctgtcaaccatgaaaagacatggaggaacattaaacacattcttctaaa

SEQ ID NO: 1140 - DNA, 2099 bp, Homo sapiens
aaagttttgagatatgtagttctgggctcttttgtagcttttcttagccctaagtcacacaattctactgtgcaaggtagtgataattaatatttccaatcttgatttgccattgcaactttagattttagggcactgtagtttttagtattttacataagttcagcctttcactcattaaacttaggtccaaataaattgcatctgtcacaatttttttaaaatttgccattacagataaagcctacaattttcaagaagctaaaaatgctatttttgctcaatgtctatacatatatttattttcagtttttccaaatctacttttatactatgtaagaattgacaggtgaggtaacaaatcagcattagtcgaatataagaatattcttagtttctaattagactattgacaaacaaaatattgcaataagtcactgtagccttcaaatttacttttaatattgcctattacaaacatgtctgaaatgattttcctttataaattcttgcacagatctaacattttgacaaaagaaaggacatcttaaaaatgaattcctgaatgtacggatagaaaatgaacatcagaacaagtgaagtgttgccttcttatcgcaagaaaagagtagacaaacagtatctattttaattcttgtgcaactcacttttaataggaagaaagtgctggaacagtcagctttagtaaggctgcaagttttagaagcttatcaggtataatatgttaatctttaaaaacagtatgatgaagtctgaagctttcagagagatgagacactgataatgggcctgtttaaaacaacataacgaaaaccttgattgtgggttgccaagcagcttccaaatgttgaaagagaaagcagtttcttcaaaggaggctgttgctcacagaaaatgcattttcattccaagtgctgcagcggcgcattttggcttcccccggggaggtagcaaaactctccagtgtgtggcacatgtggtgccttttgtgttacttgtgcatctgatgtatacaaccacagtgcacttttcagtagccacacatttcctctgggacatgcctgggtgccccataggagagtgttgagcacccagcaatcttaacaccccctggcctggggcccctaaattaggtattctagctctggtgccagtttatgtttctgtgtacctacatggcccaaggctgaaaaaatgactaggaatcctgggatcctcgtgcaaatcttcgaattggttccctgagagttcctcaagcacatattctggattgattttcagttttttaaaaatgtccactaactatctcatttaaatagcttttgtcatcttgaaaatataacccacgggttattttataagagtagaaagcagtatactctgacacattttaccagcatgtttaatagaaaaaaaaaaaaagagcaatatcctcagaaaaatacctttctgaccatgatgtacatagtttttgggccatccaaggaaaaaagacactcttagagggatgggttttaatactactttagtttatgtcaacctgaaaaattccccatgcagtggaacaagagtttgaggaccccacatgcattcttacatttcaattctaagatgaatccagatttcagaaatattaaatatgaaaatagtgcagcatagaattaaggaaatgccatatttatggtgagggagttgctgatgttgctccaggacttcccagtttgaggatttggactaaatgtgtacatctgtgggagcaaggtcctttgtatatgtttgtgtgactagcaagcaagattgaggcccacaacactgcataatctacagtacatacatcataaaacagtcctttaattttacttgtggaattatttgtcatgccaagtctttgtttttagtcatttacatttgtatttcttaccgcagtttttctaaaaacaaattaacaaagacgaatattgaaataattcgcctgaccctagcataggtcacttagcttaatttaactgcaactgtattattttccctaaatataaaacaaatagatgcaaaatgtctataagtgatttagattgtat

SEQ ID NO: 1141 - DNA, 1435 bp, Homo sapiens
tgtcctcataggtaagaagtgataaagacagataatataaagatcagtcttactataaacatagatgatgtaagataataaatgaaacacaggtattatggctaaacatagaaaaccaactagagaagtacaattacaaaagtcacttcttgaaattctgtttaactccttaagtaagtgtttctacttttgtcagtccctttaatgatacattttcatttatggtcctacatgtcttcaataattttaccctataaaagcagaagcaacagatatgctattaggctaaagtccacaggttaatagacgttctttttaaaaattataattaatccttcaaaaatccaagaaaaaaatgggtgcctaggcttaccttgtgtatgtatatgtgtgtgtttgtgtgtgtatgtgtgtgtgtgtgtacatatatatatatatatgcaagcttataagaagcataggttgtatataaagttaggttttagggatacaatctttatttaataatcagtgttcattgtacttttcctctgtaaatggatgattatctccttccagaaagtcaaggagttggctatgagcacgcaatttctaaggaaagctgatgtccagggattcgaattccagccatttctctaattctttccaaatcagacacatgacaaactcaactaataggcttacggtaaattcttttttataagtaaataaattgaagaccctacaaattgattatatctttgtcataatggacagatgtgcatgtgacctgaataatacttgagaaattctacaaccaaatggaattatattcagaagtatctagtttcatttttatctctcataaccaagacatacaatttacaagttaccttctgtatgagaacatatttctacaaaacaatattaaaggaaggtctctgccctatacttctataatcaagaggaacaattacgagaagaaatagtgggtttctcttttttgtgaaattggttttgtgagattgtgaaaaaaattactgtttttcccaatgttgtgggactgtgaaataaattacttaactacaatttaaaagcctacttagatgttgataatgcttaaaagtgagaaaagtagctatttagacagggtgtttctcctaaatcaaaaaatccatcaactaccataaaatataaaataaaacacaagacagtcaatattttcagtaagatatgagaatgtattttttgtcacacaagctgaatctgggagaggactatgatctttgttcataattaaataagggaagcattgcatatttgttacaaactttaaaaatcaaagcatttcagagcaaccatataatattctttgagcaaatgtcaatttttaatgctgaagttgagatgatgtctttcaaatgcacaaagatgaaatgtaacggatttttttgtt

SEQ ID NO: 1142 - DNA, 2373 bp, Homo sapiens
aggccatctttagaaaaagcaattcatcatatgactgcatacatgtgggtaatttcagaagaagtagctcccctacaatatatgttccataaaatatttatacttaggctacccttgacaaatattttctcttcacaatacaggaaatttttatgaacttgattttgggtatgatgatgagagcaacttgtaggctgaatattactcaaaagagcctctctcctgatgaaaagcacatttatcaaattattagtgtttcactctgtcaagagcctagagttgacagtgaggctgctttatcatcactctttgtggaatatacaattaactattacactttgatttgttcaaaagaaattcttatgtgtctacaataagtaacaaaccttggctggtctaaccctgcacctttaaattggtcaattgactcctttgacacaatactcaacaattttgaacatctttgcttttttacccattttaactatgaacattgccccatatggaacatatgccccataaggattatgaccttagcctacactccagacctcttgcttcggctcttgactagagtttcacactcattgccttcaaacctgatgatagaaaggacaagcttttggatcattttcttgaatatgattctcacttttcttcgggctgcatccatcccttcccctactccagtcaacaggctctgccactgctagtactgccagcccagcctctgcaacccttcctgaatgccagcctatgaagtttccatttctgggactagcaaagctgaaagaatcacacctccaaccatggagaatgcaaatttgaattatgcagatgctcacctctaattagtttaacatctagttgaaggtataatatatgtagacaactaaatataatgcagagcagaataaatgagtgttataacagaaatacaaactccttagcagtattagatgagttcagataaacacccgaccaaacatgcttaatttccctaaaaaaaagtcatctgatgttgacaaattatatatcataaacatagctcagccaacatgtacctaattcagttggctattccaaaggaagacagaactacctgttcctgagtaccgtagaaaaatggtgtcctagggtgagatatgtcttaacaataaatgacacctcctactatccccaacctagatttcacaatgtccaaggtggcatggtgcagtgtcacttaatttctagacaagaagacaggccccaaacatttcaacatactaaagtttgtcactgaaagctctgtaggaacagaaaaaaaaagcgttgtgagtgcccagagatgtgctgaatacctatgggaacagttcagatctcatttatacttcaatatacaaacagttccagcagtatgtacactcaagtataaatgatctcatttaatcatgtaagtattcaggtatgaatgagatcatttatacttgaatatttggttatacacagttggttacacacagttccagcaggattcagtggttactgcctgtgctgttgtgtcatacaaagtttccactttgtttattttggatattatttaaatttcctctttgtgtttcctacaaaaattttaaacattgcctttgatcttttctttttattcagctagcttgactccctgaaattccaagatatgttttggcacaagacaaaaagagctgaatagattaaatatttttctaattcttttttaaactttgaagaaagacaagttaaaagttattgtcgataccatgtgacttaatcaaaggtgctgaatgtgttttttatatgcacttcagaagaatatttgctacttatatcctttgaataatacagttgaatctcttagctcatttttcctttaacaaaattgttaatttaagatctttttaatgctttatttttaattactggagaaagccttgagcattccaagaacgtaagatttaaaaataataataaagtaagcttctgtttgctgaagctaaccctttgaatgtggatgactaatgtttggggaatgaataatcattgttcataattgtgggtggtagtttctacacagcctgtggactagtttgttaatcaaagtacaatttcatttttgtcttatataacccaatataaattatttgggatattggaaacgtaggtaaatttttaataaaccaaatattattacaggaaagaattctgaataataaagccagtgttttgttgatcttactgctgccagttaacagttactgactctgccttctgactctgtaatggtcattctcttctgacaaagtatgagtgtggactctggtctgagaatggaaaggagagatgtcctcttcctgc

SEQ ID NO: 1143 - DNA, 2895 bp, Homo sapiens
acaatatgttcacaccaccaaaagcattcagggaattcctagatcaccttaaatttttcctaattcaacatcttctggaaggaaaacacgaaagcacccagatgcctttgctttagaacaattcctgtgacttatttcgcattgatagtttttgttttaactggaattaaggattctaagggcagatctgagaagctacttcactaacagtgaaaggaaagagaatgaggaaagttgatttatccatgctgaatgaataccgacttacctgccccaaacagagaaacaactaactaaacagctattcagtaagcctgctacaactaccccagacccaccccaggcaaacagggacttcagaacacttatctcccgaaggaagctcttgcaattcagatcacaggctttattttttaattcacccatgtttgcttcaaaagagctcctctgctgactatggaagaacaaaacgaaaaagccaaagagagaaacacttaaggatttgaggttggggaaatgttagaaggtgagaagtcgggcagtaaaaggaaaagaaatatccactcactaaatctaggacagccttgtacagaaatctgccccaaattcatgtttctccacctcaggaacaagaggagctcccttgtttgtagttagaattttaaggactagtgtctttgagccaggtaaacagtgagtctgattctcaacaattatgaaagggccaggtttttttcgtttgtttgtttgtttgttttcatttttgttttttttgagacagagtcttgctctgtcgcccaggctggagtgcaatggcaccatctcagctcactataatctctgtctcctgggttcaaatgattctcctgcttcagcctcccaaatagctgggattacagatgtgtgccaccacacccagataatttttgtatttttagtagagatgaggtttcaccatgttggccaggctgctcttgaactccctacctcaggtgatccacccacctcggcctcacgaagtgctgggattaaaggtgtgagccaccgcacctggctatgggccaggtttttaaaactgcagtcacatgtttatctaatcttcataatttctattatatgtgtgcagaggtgaccttgagaatgtgcctgtcagacttctgatttcagggattttactgacacaggggtccagctctgcctagggaaatccatagtcccatttgcaatgagcccttcttccccccagctgctcccagccaatggctgcatgcagcagggacaccgcagggggacctgtccccaggcgctgtccctccagtgggcaccaataccagtgttatgggagttgatttcgggcactgtgctgaatatgttcagtcttgctacttgtgcattttttaatatgtgtgatttcaaagatgatgttgtttaggaagaggctaaatatgggtttctcaaaaacctcaggcaaaggctttggcaggaagttcacttggaaaggtgttgcaggaagcagaagtgggggcctgggaatgtgaaacaggaagggagggaaaccgataggtggatgcatgattgagttgacaacactgctgcatttgggcttgagggttctcaaaggcagtcttgccagactcttccctagtcctgcactagactctgagacttgggcatgaggaataatcttccttccttccctctctccttcactcaggatcagacctgctgcatagcctgatggctctctcagtctctcctggctccctccctattatctctcatagcaaccttgtccaacccatggcccgtgggccacatgcagcccaggatggctttgaatgtggcccaacacaaatttgtaaacttccttaaaacatgagggttttttttgttgtttgttttcttatcagctatcatcagtgttagtgtattttatgtatggcctaagacaattcttcttccaatgtggcccagggaagccaaaaggttcgacacccctgtcttatacacatgactcctaacatgtttcttgtacatttaatcccatcttttcctctgctacttggacaacccagattaacatacgtagtaatatcaactgcattatgtatataattatacaagattatatatttatatgtaattttatacaattatgtatataacacatacacttaaagtaaacttacagtggcatattggacacctccagttcattatttagctaatctagggcctacctcttactccagctactgctgcggtagccagttacatgtaggtctcagccagccagctttgcatagttacttggttagcacctcagaccacctgccaggactgctggccactcatgctcgtgcaatccagaagagtgggtccacctttgattagtggaggctgggagttgctggataaatcctctccccttccatcccctgagacagccctgagacccatgtcataagatgcctcagaaggtcctgtggatcaaacgctgcttgactgtagcaatggtcaactcaatcatgcctccatgtatttctttcccttgatccccactttaatctcccagatcctcacttctgcttcctgggatacctttccaagtgaactctctttgctgtgactttcagggaaacccatactcagcatcttcttaaacgatatcatttgtaaagtcacatttaaaaataaatacacctgcattaaaacaaaaaatagtggcagggtgtggtggctcactcctgtaatcccagcactttgggaggccgaggtgggcagatcaagaccatccgaccaacatggtgaaaccctgtctctactaaaaatacaaaaattaggtgggcgtggtggcacacacctgtagtcccagctactcgggaggctgaggca

SEQ ID NO: 1144 - DNA, 2850 bp, Homo sapiens
cctctgtttgggcttccccatctctttctacttctaccgcatcagaagtcttcattctcttgtcattgctctgccatttgcatcatattcgcaatagggttaggtactgccctgtggatagattgaaaactctttggcgaaaaggttggaactcctgaatatttagcgcactgcctgatacatggtgggatcttgcattcgttaaattggtgttggatgtgacataccactcagtagatttaagggaaggctaaggcacaaaagaatattttattctgagatcaatctgattggttacacaagccaaagcattcaagtgtaactggtgtgtgtgggtgtgggtgtgtgtgtacatgcacatgctttaactcacaggctttttgttgactggtttgaggtacatgtgtgctagagtgcatggttataagcttcaattctggtacccatcgacctgggtttgaatcctcacacactgtgtggcttttgggggaatcattatataatctctctgtttcattctttttatctgtaaaaagaacaaaaataaaacctcattattgtgaaaattaaattgacttccaccagtagagtagctagaacagtgcctggatcacagcaaatactcaataaatttaagtttgtattattatgaatgaactctggcttagagtattcattcatctgagtgtatagacacagaatccaacagctcttctctactacacaaggtgcacttcatatttttcttgattgttttgcctgagaggttcagctgctcgattctccatacaaaatcaccatcctgtggggctgggcagcaggtggcatgctcataaaagcctatcatggtgtgtcaccaccacggcaagtcacagatggcgtcctgagacaccgtgatgcaaacgagcaagaggagactgagatatccatcaagcttccgtgaagaatcacagagctcctcatttatgtgcttgtcaacattttatccacgtttattaccttcgtgagcatttatttttccttatcaagtcccaatggtagattttcagtctctatagttatggacataaactttcacattttcaccaatttccttccccatcagccctcatctgatctgtatttgtatcctcttgcttgtgtgagaaacagagcttgctcacaagtgtcgaatggatgaaacgtttctcatggtaaggcaagtttgtatgtcctctgaagtctcctgcaaggcacctcctgacctccacgcacttcattcatagagctttgaaatttgttcaacttgctagcaagtcggagagtatttacagagcagggatgagtcaaatggggaacatgaacagatggagaagagccagttgttatgcttcaagtatgtttcccacattggaatgtgtcaaagcctggcggtatacactgcatgcgagtcacccacatagtataaaactgatttaatttactaccaaacgccttcattttgccattacgtaatcataaatgtgcccccaaagaggcagtgttagaacataagccagggcaaagagccaaccagacatgagatctagtcctagttatacaacctcattcatgttcctacaaatcctcagtggcctttcagatctgtggcaggacataccttgacaccactctggtctgttgacttgtctttcatttacctacctggtgagctgtgcggtttagcagctagattcctgggcatgctggagagatactggagaactgacactggtgccttgagatgtcgtggcaactgtcagctccacccgcccccacatcctgtctactctctagtgaaattgctgctctaaaaaaagacctcagagcagcttgagaagggcctggagaggacggccctcctcacatttccccccaaggtcttgctgttaaatctcccacaagctctaagagcaaattgtcagtgatccacttacccagccctaaacacctcagccacgtctacccagatgaaggaaattgctttcagggatagatgcatctcaagaaagttggctataaaatggatttttataaagagaattccattttctcctggcttccattacaaaattggaaaatttgtcacactggaggaaagaatcctctcaggagacaaaaatgaacatttgggatgagaaattaatgtaaagccatagcaatgacacgtctctcattggaacgcaccagtgcctgctgggaaccacctcatggttcactttccctttgaatcatttccagtgttttgtggaagcgttggaactcatgaacctaatacacactgtcagtcctttccctccgccacccaagacttagaattttctccatgagcaaaggttctatttccatgttcttgcacctcacaaaacttgctactgctcactcgtattagtttgaatatggctttaggctgcaacataacattttattctttcattcacttatttataccccactttattcctataaatgatttgatgtggcttaaaggaataaacgagataagatggtgtatttgcatttcagattcaattctacttgtttcatctttacttgcatttcagattcaattctacttgtttcatctttacttgcatttcagatttaattctacttgtttgccctaattaagtcaattttgacattttaatgtcatgagccgtagcattaaataataaatattaatctattggagctgaaagagtctgataggtcatctgggctacctcccacccagtacagcttccaccatagcctgtccagtgaaatgcagtggtctttctaccttggctctataacagatcataagaaactgcacaaaacttttctcat

SEQ ID NO: 1145 - DNA, 1922 bp, Homo sapiens
aaatgaaggatcaagatatgaaagccatcgtaacagtatttctgatggaatcgccctggtgaggattttttaaatagtagcagaggaggctttgatttcttcccatgacaatgttgcaaatgagcctaaatacagctttgcatttgtttaactgaaagctgccatttctcagtgtcagttgggcgttgtatctcagaatgacaagtgctgttaacttcagctaccaaaaaaaaattaccaatcttagcatatcttcaccagagtataattgttaaaatgattctatgagagattctgcaagaaaaaaaatgtacaaaaatcggaattacttggggaaatggatgggatggatttgcatttgatatgacttacagttggcaaggtgaagaaaagcataaatacattgaatttccctgacctgggcaaattcatcactaataacaggagtaataataacgacaatacaaataaagaccatagaatgatacaaaggcctttcaaagatttttacacgtttttgtctaaataatagtttcagaaccaatttcaagcaaatatacttaattccatgtcaaactaaacttacagggttgatcagttctggagcccttagtcatgttaaaaatttgggctcccttcaaatagtgccttttttagattatttacattttgattcacaaaaatgtgattttctatgtcatatctcaaaagtacagttttgcataagccaaggtgccccttaatggaaacatgactgtgttattggtgccttctggatgagcagttgcctttcatctagggtgccggtttactgatgctgcttcttcgtatacatgtgtctgccccattggggaaggtgggagggaatggatttagaagattgggtatagcgctgctaaactctaagtcaatttgcctgaccatgtgttttcaggcaattaaggaaatacacttgaaagttaactcataggaatgtgcattgggcactgagcacggtccatttactcatttctttcttaaggatgatgtatcattgattcctcagtgggatctccttggtctggttctcccatcccaatggatgtcaacaaggcttcctggaaaggaaggatggaagacttgggtcatctattctctaatcaaatgtataattaaaaaaataattttgagactgagaagcctactacttaagccgtaactaaggaacaagtctgcattaaagtaaaattactggcatgctaaaaaaaggtggcttaagaaattaaaactcgcaaggtcaggggaatttttagggaggcagaattatctgggtcctcaaggaaaagaaatagaaaaatttctgcactaattcttttatttctttaaacagtctagaggtttattgaattacagttataagtaagaaaaaagcagtttgcctttcttggggaagaatattttaagctcttattttttttcttttaatattaacagagtttctgagaattctaaggaaaggcttttcctagtatcacaaaaagaaagggcaataaagttttgaatttggtttatatggctggcatttaggaagatatagtaaattattctgatgcattgactggtaagttttttggtgattcgtatcaggttgctgtatttattttaagacctagtgtataaatctcatttccattaattcaaaaaacatttatcaagcaccaatcatgtacctgaaactgagttaaacacggcaattctctgatgagagcaatactaccatttatttaatgataagtaaaatcaaataaaaactatgctacattaggcccttgctataaaaatttaatagaatcagagttggaaagcttaaaaatattttagaggtcatctaatctatgacaactcatacacacaaaagtatattttacatgggacccagaaca

SEQ ID NO: 1146 - DNA, 2058 bp, Homo sapiens
cctgtcaccatagtcaagcaagtcaagctagaatctctgactgtgtcagcctccggggttttgtagaaaatttgtattatggagatgtgggctaaatactggaggtgattcacttcagaaagctaagcattgggaaaccatctctatcacagtaaccatttatgttaaagaaactgattttgcactgtttttagcctcctgtattttatttctttccatcttaatctaacattcttttctagacaagagatgtttattgttatttgtcagtggcaatagccagatgttctagatatacctttgttaaaggcaacacaattatctcaaagggcaatatttattttagacactaacttggcctctgttgccaatttttctagttatggttagttcattgtactttgtctccaaaaaacaaatatcccaaattttttacatgaagtgtacactcaaagcaggcatcttaagttgttactacctcttatttatattgcattaagtattttattcactcccacaataacgacaactaaaaaaaaacttcctgttcattgataattagatgttttgcttcatttggacttcctccaacaatcttctgttcagattcagctcttataattaattatcctcttgctgaacaactaaaaactgaagtctgaccaaagtacatctcatcccacacagatgtcctagttactccacaaaaggttaattaatcataagaggtgctttagagcaggaggcgctggaagaaattcagacctagtttctggcaacacagaaaaactaccatcatgccccttgttattgagctcacactgagagaatcatttcaatggagcagaaatccaactgcatgaacgaaatagctggtggatataatatcatgcctcagataatggagcacaccacttcccagtcactgatgattcagaatcccagcctgcctgcaagagaaggtcagcactgtttgtcctcatttaacagaggtgcctgaaaatcccaaatcgcaacaatggcagaagcaatcttcattgttctcctctctttggctgggtgccattttgtaacaggaatgagccctcttctccagccaaaacagtctacacacagtcgtccaaatacaccttgcattttccaacctgtggcttcagtcatgctaatccctccagtccaggtataaacttgtcttcttccaccacctagccaaaccctataattcagtcaagaaccagttcaaataactcttcctcatacacctgcatgcggaacattccaacccaatggaagtgcgtcctcttttgattcaggagcagctgtggtgcgttagaaggagcactgtcctgaaacagaaaatagatgcaatattggctgtattaaatgtgtaactttgagcaagatatttaactcctgtgagcctcagctttctgttcaataaaacgagaagaagaatagctactttgtaggctttattgtggaaattaaataaaatcaggattatgaaaatgtttatcattttgttgctgctcagcacatatttctttgcttacttgataattgacatccctgtgttttagtttgctttctttagttgttttttcttccccttttaacaaaagatgtgagagaaagtcaccttaaaatagttctcaaaatagtaatcatcatcatccctttctgggaacagggatgtaataaattgtgtgctctaaagatctatgagatttccttttggaggagcagggacagaaaagaggtcaggactcagatcaagaatctgaacccatcatggccaagcactggaggactcatttctggtgctggagatggctgtgaattgaacaggagaagagtccactgcaataggtcatgctgttagaggtagcatccacaggagatgagcacaactgtggttcccttcacccagacgaggtgtctctctgttaccagcatgctttcctagacatgaagagagactacatatgagtttccaggtccccttgggaatcagaaaaaaaaagtgctccatattctggagatgaaagggaagtgatg

SEQ ID NO: 1147 - DNA, 6452 bp, Homo sapiens
tacagtaacacttgtagtccccatcataacctcttgaggtagttactattgttattccaattttacataagagaaaactgaggctcaagtaggttaaatcgtagctagtcacctagctgttaaggtgatagagttgggatatgaactcaggcaagctgactctatgcatttaaccactgcatgcttaatgttttgtaaattttagaaatatgactaacactttaaaccactcctgtgtgaatatcatataactagcatttcaataaatgttaataaatggcttgctctactgcattcttaatatgagaattagcatcagaatcaggtcaaattcagttacaggtaatttgatgcacagacattggttttgttttattttcattctcttattttgatggaaatatgctgtaatgagtgaattgtgataaagcacaatgatagtttattgaagtaagagattagaaagagctgatgctttcgtcttactatctttctaaagtgacagtgaattaacaaattaagaaaaatgttttaaacagaaaacaatacaagaggtggctggaaactcttttttttctacagacttgcaggtatatatgtatttgtggatgcgcataatgtggcctattaggtctttgtaactgattgggacttcagtacgtttgcctgtcaacaaacaggaaaaataatgaactttgaagagctcggcttatctttccttttctactctcttcctacattttaactttaaaattaaattgttaagttataggtatttatctaataactgagaggtactctcgaaagaacacattttacaaaatatgaattaatcaggataagagaggctatgctacattaaaacatgggccagtgagggccagtggggggtctcatgcctataatctcagcacttcaggaggcaaaggcgtcccaaagtggatcacttgaggccaggagtttgagaccagcctggcaacatagtgaaaccccaactctactaaaaatacaaaaattagccggccatggtggcacatgcctgtagtcccagttcctcaggaggctgaggcaggagaatcgcttgaacctgggaggcagatgttgcagtgagccgagatcgtgccactgcactccagcctgggcgacaaagcaagactccatctcacaaaaaaaaaaagccagtgacttaacaaagttgaatttcttgctcacacagagtgctatggcaattgggcactccctagcatctgtcctctctttgggaactcaataaaccaggaggcatccatccaatggtttcactgtctcagcacatggctttccaaatcatagctgcagagaaagacaggagctgaaggattgcacacaggcttgtaaatggtttggttcagatatggcacgtgtcactcctcttgtagctcaatcaccagcatcgaactcaaccaagaatgactggaaaggtatggatgcacacacatctctggtgggtaaagaatgtctctgacacagagcattatatacatgcttccttactgctactaccactaatgctaatactgtatgtttatcacaaccaaagtttgtttgcttttttcatctttttcaagaaacaaacttttggttttattaaccaattctatgaaggttgttttgcttcattaattttgcttttatctttaatctgctgtaaattcatttactctttgggatttatttttgttgttccttttctatcttgagttgagtactttattttgaatctttctcattttctaataaaaaatcaagcctacaaatttccttctggatacctctttggctgctttccgcagttttgatatatactactttcattgtggtttcattctgaacatttcacaattttattttgactgtctctttatccagagaattacatagggatgtgctttgttagtctccaaatgtacagatatggagccactctcttttgttgttaatttattattgtattacatcataatcaaacaacatatcacctatatgaaatcaaacattttttaacttgttgagttttttttctggcagactactgctatagatctttttgtaaaagctccttatataattctttaccttgctttagagagtgagaaaattttagaaaaaaacaagccacaaaagaaatctcagcaagttaaaaaatgtttgatttcatatgggtgataccatgttgtttgattatgatatgatacaataataaattaacaacaaaagagagtggctccatatttattcagataccactttggctgctttccacagttttaatatatactactttcattgtgatttctttctgaacatttcacaattttactatgacagatccaggtattgtatttttatctgccacataatgcccaccacagcaatgacgctcacagacaccactggttgaaaacctcagctctattttgtagatttggagtttaaggaattgggtgattgggagaagactgcaggaaaagctgactgggtggtagtggacatgaagaattttcttggtttatattaagtaaccatatcttgttcatcattatatcttgcttatctttgtatgcacaatgcctggcacagagaaggcaatcaataaatgtagatgactagatgaattagtatttacctaggcaactatgagcatcacatgatagctaatggcatgtaacagaaataaaatcctatttcatcttctgaaatatcaacagcttgtgagaaggtgtcacaacatttacgttacttttgtatcttcccccatgcacaatgttaagcacaaagtaaatacttttttttttttttgaaatagagactcactctgttgaccagcctggagtgcagtggcacgatctcagctcaatgcaaccttcacctcctgggttcaaacagattctcatgtctcagcctcccgagtagctgggagtacaggcatgtgccaccacgtccggctaattattacgtaatttttagtagagacgggggtttccccatgttggccaggctggtctcgaactcctggcctcaagtgatccaccagcctcggcctcccaaagtgctgtgattacagacatcagccaccacatctggcggcaaatacttctttttttttttttttcttctgagacagagtcactgtcgccccggctagagtgcagtggcgtgatctcagctcactgcaacctccatctcccgggttcaagtgattctcctgcttcagcctcccaagtagctgggattacaggtgcccaccaccacacccagctaatttttgtatttttagtagagacggggtttcaccatgttggccaggctagtctcgaactcctgacctcaggtgatccacccgccttaacctcccaaagtgctgggattataggcgtgagccactgcacccagctggaaaatacttcttaaatgcaatttataagcatgtgtattagtttcctattgctggtataacaaattactacaaacttagtggcttaaaacaacacagatgtgttgtcttacagttctagaggttagttctaaataggtctcactgagctaaatccacggtgtcagcagagctgtgttctttcctagagcttctaggggagaatctgttttcctgccttttccagcatctagcagctgccacattccttggcttgggaccttgttccatcttcaaattcatcagtagcagttctttctcacaatgctatttctctgtttctaactcttttgcctctactttatccacttaaggactcaggataatcttcttattttaaggccagctgataaacaattttaagtatatctgcaaccttaattccccttgccatgtaacataacatttacaggctctggttgtgaggacatggacaccttttgggggtcattattgtgtctatcatagcacgtaaaacaaagaaaaaggacaaatagaagaagaaaagacagtgaatggacacaatggagtgacagagttaataacagtaataacactagagatataaggattggtgcatggactacaagattctcgaacaaggccaaaaaaaggatctgtcccacactattagctaaattcaagcacttgcacacacgtgagtgcacaaacacacacacacaaagtaatattctggttagctgatgtcactgctgggatattactgtttactaataataaaacaaactacacaaggcatgaatggcacgtgtgttatttatagtttttgtagaagaagttctcaaattcctttcttcctgaaaaaggattattttcttaccctttgcattctagctcacctctaacatgtccagaaatttctaggaaggcagaggaaagactctacatttgcctccccaattgaagccatcaccacgcaagggctgaaggtgattgtcaaagtgccctcctgagactggacaccgctggcctaaattagaggaggaggctggtagacaccgccccctcgtgcagaggggcagagaagccattccccatggctccccacctgtcttgctggaggaaatttcttggctaaaagtccatggaaaatggttgtttggaaagtgaagttccctagagctttgagaatcaacttttttttttttttttttttgagatggagtttcactcttgttgcccaggctggagtgcaatggagcaatctcggctcagtgcaacctccgcctcctgggttcaagcgagaatcaacttttttcatcattttaaacctacttattgggaaatctctctaaaatatattacagaaaaagaataatcataccgagtcaatactgcatgaaaagatataatagcatggaataaattattcatttccttgcctcttagagagtactctgagtgcaattttaaccattctttctggctgtgaacctcagagttttttacagttctgtagagcagatagaatgccaatcttctttgcatatttatgtcatttttaaaaggtttttgttgctgttgttttattttgttttgtttttccctcctctgtggttgtcagtggtcactttttaaattttggttttgtcagtgtgacttcctttaacaacttccttcctcttctcctttgctatggaaaatagtaactaggataccaatctagttaaacttgtaagtaaaatgaggtaaagtgagatcctaataaagatacaagatacttacaagtgaagtgtatgagatttaagacaaaaccagagtgacgctgcaggcaggactgcccattccatctggaatgcatgactgtctgtcatctatttggctacttagaaactatttttacctcttctctatttttgttctgaataggttagtgtgaaataattgttttagcaagatgaaatattgctatattttttaatgtgccaaagtcttcttttttttttttttttttttttgagatggtggtctcactctgttgcccaggctggagtccagtggcacaatttcggctgactgcagcctcgacttctcaggctcaagcagccttccagttcagcctcccaagtagctgagaccacaggtgcacaccaccatgcccagctaagttttaaataatttctagagacaagagcttgctatgttgcctaggctggtcttgaactcctggactcaagtgatccttccacctcggcctcccaaaatgctgggattataggaattagccacctcacccagccaaagtcttgaaatgggataaaacaggagtcctcagtcctggtattgaccccctcaccaaagtcacgcccctttcgatgtttatagcaacttgataaaaaccagggctgtgaattaaatgtccattaacaaaagaataggctcacttttataacaaaatactatgcagctatgaactatgtatactacatatttataaacactaagtggaaattatgttccttcttatattgtttagttagaggagtgagtattgacagaaaaatgcttccctctttgatcccccaggttgacagttctgagatgcattgcacaaggccccccaggaggtcccagcaaaatctagcaccagttactcacggcactgtccagctcagtaatgaacctttctattagccgcccctctttccctgcttcccccactccccgccctgatccctgcccctacgccctgcagtcacctccccaagtcagtgcatacaagcttttgtctcagaatttgcttttgagagaagccacattaagaaagacattgctggccaggcctggtggctcatgcctgtaatcccagcactttgggaggatcactttaactcaggagttcaagaccagcctgggcaacatagcaagaccttgtctctactaaaaaaatgtttttaattacctgggcatggtggtgtgcacttatagtcccagcaactagggaggccaagacaggaag

SEQ ID NO: 1148 - DNA, 5948 bp, Homo sapiens
ggctctgcttaaccccattctgtctaatcctttttctaacctatctgtcaccagcagatccccttggcttctgcctcatgtgccttgtgctttgtccttctgggatcttcctttgcccacacacggcaccaacttgcccagaccacacaatgtgaaacaaacgggcaaccgagcagccggtgataaccagataaagtcagagccaaccaggaaacttagtactttattattttgtaatgttcaatctttcctaaatagtcagtcctggatttcaccatttttctgttcactgtctgtgtgcaatcttttccattgcttttgtctatatttgctctttaaaatttcccagtaaaatgacttggtatgtcacaaaaatctcttcattagtcattttttttttaatcggttccttcgtcggcttatccatccctgtgctgtgagtccagttctggccctcacactcctgcaacctcctgaagctggccatgggcccagccgctgaacttgtagctgttgatcagagaggcacagagctccctgtgctgctgctctgacatgatgtcttacctgtggggtctgtgtactcggactctcccaaggattttctagggtgggatgagggtggtgtgaattgatggtggtgataggtctctgtttctccttgaaatttatctaggaggctgggtgtagtggctcatgtctgtagtcccagcactttgggagcccaagatgggtggatcccttgagacccgttgttcgagaccagcctgggcaatataggagacctcatctctgaaaaaaaacccaaaatgttagctgggtatggtgaagtgctcctatagtatcagctacttcggaggctgaggcaggaggatcgcttgatctcaggaggctgaggctgcaatgaactgtgacaacatcactgcactccagcctgggtgacagagtgagacactatctaaaacaaattatgtaggaaatgaaaaatgagccccaaaggaggggggaatggatgtagcctctaccttgctgtgctcagtggtttctgaaaagactggaaagtgtttgccaggacaaggaggttgagcactgtggggggtggggcagttccatgtagctcatgtccttgctggtgttctcggcatggcctccgagaccactactaggcatcagtagtcgtaaagacttgtaaataaataagaaagttggggctgggtgtggtggctcatgcctgtaatcccagcactttgggaggctgaggtgggagaatcacctgagtccaggagtttgagaccagcctgggcaatatagtgagaccctatctttacaaataatcaaaaattagccaagcatagtggtgcacacctgtagtcctagctacttgggaggctgaggcaggagaattacttgagcccaggaagtcgaggctatagtgagccatgatcaccagcagtcagcttgagcaacagagtgagaccctgtctctaaataaataggaaagtcattctaaccctggttatggcaatgaaacagattccacttaggagggaggttggctacaaaagcttagagaagtgtcatgctcattcaaggtgggagaaagaacaaactcgccaaactcgtattagattggagctcaccacagtgtaccaggcccaaggcagtttgcttgcactcaaaaatctttttttgactaaatgttcttcatgatctagactacgctttggcaattttttctgtgaagtatcagatgtaaatattttcagccttgcaggccacatgatttgttgtaacttgtcaactcagccattctacctttaaaacagccactgacaacaattaaatgtgtaagtggctgtgttccaagaaaatattgtgtacaaaagcaggtggcaggccaaaagtgggcatcagtttgttgacccctggtcttgacattgaacggtgaagatgagtgcaatgttgcacagtggttaagagggctggctctgaggtcagcctgcctgggcctgttttccaactctccaatttaacagtatatgctttgcaaagttatttcaagaattaaatcaaatgatacatgtaaaatacctagaattgtgcccgcaacattagaagagctcaaaaagatttctacagagaaccagaaaggtttaagcattgtggaagtactcgtaatatagatttgactttcttagcgactgggggaacatgttctctgtgctccaatgtcctggtagaccctgatcttggcaggaccacgtggggcgccagagctctttcagggagttggttctcctctccttcctcagggttcagctcagatctcatttccctccatagacagggcctgcgactgctctcccagtgaccaatgggcccctcacatatctttagcaaaactttttcgccgggcgcggtggctcacgcctgtaatcccagcactttgggaggccgaggtgggtggatcacaaggtcaggagatcgagaccatcctggctcacacggtgaaactccctctctactaaaaatacaaaaaattagccaggggtagtagcgggcgcctgtagtcccagctactcgggaggctgaggcaggagaatggcgtgaacccgggaggcggagctggcagtgagccgagatcgcgccactgcactccagcctgggtgacagagcgagactccgtctcaaaaaaacaaaaaaacaaacaaaaaaaaacctgtttgacgttggactaggaacatctgctcagtctgccctcagcctatgagaaccatttcctttttccgtttcctcgtttcccatctttatcttcccgagttcatgcacacacgtgccgctttgaggctgtctcagtcaccttcgtagatcatccctctcactcccacccatgcccagcgcccagcacaacacctggcaaagaagcgtgcagcacggtgtgattgttctgtcggcaaagaataacagggcacatgttcagcttgtgtttctgttgttgactgtaatcgctttggggaattatctttattgtatccattactgtaatatagtacgatgaacaagaatttcaagaagactgttggcatttgagaatttttaatgggaatgaagttctctaaagccatctaactgacccatctctaggttttcttttttaatttgatcctacaagctgctgtcagatatatcttcctgaaatgctatatattcattttttattgtgctatataattcacttgcaaaagaaacatcaaagtcttcacagtctaaagttcataactactctcaaattttatttccagcttaaatatctattaacttcattggataaactttctactgtaggtaaattgctttccttcctgtttcctgaataagtcttctattttcccttaacaacgtgtagcctacgttaaaattctaataataactaacatttattgagtgattactatgtcccaagccctattctatgtgttttatatgtgttatcacatttccatttcatagtaaccctatgatatacatactatttttccatcagggaattcaggtataaaaagatcaggtcacatctttctagaagcagaggatcagtttacataggataatcccagactgcactgcaccataccctctaccctctgcttctccttcctctccacctattcaagtccagttttccattcaagaaggctctgccttcttcataaaacctccctttcttctatctaattggaagtaatttgtctcttctcttgtaagttttgatattcaccagcaactactttgagacaactcttattgggctattagttaaatcttttttcttccttacttttcccaattatttcttctcatctctcttttttatgtatttatttgagactgagtttcactcttgttgcccaggctggagtgcaatggagttttactcttgccgcccaggctggagtacaataatgcaatctcggttcactgcaacctctgcctccccagttcaagtgatcctcctgccttagcctcacgagtagctgggtttataggcacccacttgtatttttagtagagacggggtttcatcacattggccagactggtcttgaactcctgacctcaggtgatccaccccccttggcctcccaaagtgctgggattacatgcatgagccaccatgcccgctatcatctctcttattaatttgaagtaatttagacatatatatctttatatcacctgtattgccttgcacattacaaggtttcagcaaatgcttgttgattaggtttgattttgctcaaatgtttatctttcacaataggattacaagcaggaagttaatggatagatgcactgaatagcatcctctatttaggacagcaacacctggttatatttaactggcatgcttatgcacttgagccatgctttatgtaggaacttatgctactgactaataggtcacatatttgaatcccctgtggtttccaatgacctggattttacaggttggctgattggggcttgggaccactgtgtatccccaagaagccgagcagagctgcctgcctgtatgtaggtgaatctgaatgcaaatacactttgaatgagttctagttattgcccaatataattttttttctaattttggtttaaaagttcaagaaaagcaaagaacctattagatggtatctgtgatctgtgtaggagtctagtctagtctttgggtaattagtctttgggattcctcttataatggaaggcattattgttagtattaaatacggtggtgggcaatatatccatgcaacaaacctacacatgtaccccctacatctaaaattaaaaatatgtgcatggggctgaggcaggagaatcgcttgaacctgggaggcggaggttgcagtgagccaagattgtgccattgcgctccagcctgggcaacaagagcaaaaatctgtccatatatatatatatacacacacacacacacacagacacacacacagacacacacatatatatacacacacacatatacatatatatgtgtgtatatatatgtatatacacgcatatttatacaacatataacatatatattatatatgtatatatgtgtggtggtccaggattcaccagaatgttggagtgccctgagtccagatttcttcaacctctgtctaccttttctcaacttaacccatccaatccatcatctctttggctctgtgaagtgtccctaatggacatccttttgccacatccattgatgtttatttttcctctagggcagtgtagcagtgtacagaacccttctttcctttcctataagaaggaaagggaagcagattacttttttttcttaaataagcgtgctctcccactacttacaaaatatagaaaaagtacacagttacaatgttcaaggtacaaacaaataattcaattttgtttacagaaaacaagaaactttaaattgttgttaatccattcgatattaattcagtcaagagcagagcctctgaatggcaatttccacattactgtgatacttgttcatacctcattaattatctgaatacctagtttgaaagttggctgtgggggtggggaaacctaatgaaacaattctcgctacttgacttgtaataaatacactttctagcacgttcactgcatgtagaaatttacattttgacctaattgtattgagcattggtaggaaaacagtgagcagttgcaagtaggtgattcccgactactcctcatatttccctgtctccaatctttttttttttttgagatggagtttcgcctaggctggagtgcaatggcacaatcttggctctctgcaacctctgcctcctgggttcaactgattctcctgcctcagcctcccaagtaactgggattacaggtgcctgccaccacgcttggctattttt

SEQ ID NO: 1149 - DNA, 4795 bp, Homo sapiens
gactagcaataaatcattcttaactgctctttaatcaaatgttcagtccttcattccatagttccttccatagggaacccttggtcggcttcgttaaattctgctcaaaatacatgctttccacacccatacttccctatttggatgttttactgattcattttgattcttctctacatagtctaaatcagcaaatatttaccatatgtactttttaaagagttgaaaggaagttatccctatattctagcgcctcatgactcgtgtctcagcatgaaaagtattttttatccagattacttaaatcaacattgcatgccaacatttcccatctgaaccttggcctgcccgtttttcctggcaatgttgcttaacacccactgaccatgtagtctcatcatttttaatggtgatgaggcagatttcctcctagttcacattgaatagtctatgtcactgatcttgctatttggatgccatgagctaggactagggactcgtttcaatggcctgtttctctatcacccaggaaatcacaaggctcaatgaattgctgatagcaattttggtactgaaaagtagggcggggctataccaaatatgtaaaagtgtggaagtgcctttggaattctgtgatgggtagaggctagaagtgttttgaagcacttcatagaaaaagcctagattcacatgtctgaaattgttggtagaaatacagacattaaaggcaattctgggccgggtgcagtggcttatgcctgtaatcccagcacgttgggaggctgaggcaggtggatcatgaggtcaggagttcgagaccagcctggccaacatggtgaaatcccatctctactaaaaatacaaaaattagttgggcgtggtggtgcgtgcctgtaatcccagccactcagaaggctgaggcaggagaattgcctgaacctaggaggcagaggttgcagtgagccgagatcatgccactgtactccagcctgggcgacagagcaagactctgcctggcggagtgggggtgggctgggggaaagacaattctgatgaaggctcaaaaggaagagaggagagctacaaagaaagcttctattgtcttagagaatacgtgtaccaccatgtacagaatgtttctagaattatgcacattacaaggtgtttctggtgaggtctcagatggaaaggggtagcatttattggacactgaaggaaaggtgattgatctgtgttataaagcagcagagaacttggctgtattatgtcgtggtgttggaaggaaagcagaacttgtaagtgatgatgcacttggatatttagctgaggagaatcccaagcaaagtgtgcaaaggggaagcctgttgtctccttgttgcttgtaataaaatgtgagaagaaagagataaattaaagaaggaactgctaagcaaaaaggaagcagtacctgatttggaaaattctccacctgtccaaatagtatactatagaaatgtcaaaagtatggctcaacaagtgtttgctaaataaatgaggtgtgtggctcatggatccaatcatttatctcatcagaagccaagaatagagatgtagttgttcaggaaagatctgtgcagggccctcttgtctgatggcttagatcaccatgaatttcttgggaggctgacaacgtttttgagaattttataccaggagaaacattgccattctggactgaaagagaccataaaattaacaagaatgacttaaagcctggagtgctggatgcagaggccagtctcgaactcctgaccagttcgagaccagtctagccaacatggtgaaaccccatttgtactaaaaatacagaaattagccagacgtggtggcgggcacctgtaatcccagctactcaggttgctgagacaggagaatcgcttgaacccgggatgcagaggttgcagtgagctgagatcacgccattgcactccagcctgggtgacaagagtgaaactccatcacaaaaacaaacaaacaaaaacattgtagtcttttatgagaacatctaagtttttaaacaaccaccatatgggtgtaaaagatcatcaggccatagaggattatgctcaggccttgaagtctttttttttttttaattgtaagttttcttcagtctcagaaggtatcaggccttgaaatctaatggaacttgccttcctaggtttcagacttgcttgggacccatgaccccttttttctttccaatttctcccttttggaatgaaaatgtctgtcctatgcctagatattgtattgtgtaagcagatgactcattgtctgacttcacgggttcatggatgaagaagagtttgccccagggtgattcatactctgagtctcagccatcagtgatgtagatgacaacatttgggactttgagttcatgacctttagatgaaattttggacttagagttgatactggaatggttaagacttttgggaatatttggaaggggtggatatattttgcatgtgggaaagatgaattttggggcaaaggggaagactattatgggttgcttgtgtcccccagaaagacacgttgaagtcctaatccccagcatctcagaatgttaatttatttgaaaatagggttgttgtagatgtaattagttaggttatgataaagtcatggtggagtagggtgtgttcttaatccaatgacttggtgtccttataagaaagggaaaagagacacagagacagacctgacagtgagaagacagccatgtgaagaccaaggcagagattggaatgatggatctacacgccatggaataccgagaattgctggtaaacaccggaagctgaaagatgcaaggaggggctctccccgataggtttcagagggtacatggccctgttgacatcttgaattcagacttctagcctccaaaactgtgagacaataaactcacgttgttttaatccaaccagtatttatggtatgtcattaaaaccaccctaggaagctgacacagattgtgctacacctaatttgaatttttaatcatttgcacaaaatgtgggattaaatctttaattaaaatatttcatttaaatctactgtattctgattttccatgtatcaatactttcacttttgttaaatacaaataggacagatgaatctatatttacatatggagtgaaattttccagtttgtttttgttatctttagctaggtaataaatgttagttacaccccgtgtggtggttgtttgaaaacttagatgttcacataaaggactacagtgttatttatttatttatttatttatttatttatttgtttgtttgtttgttttgagacagagtcttgctctgtcgcccaggctggagtgcaatgatgcgatctcgcctcactgcaacctctgcctcccaggttcaagcgattctcctgtctcagcctcccaagtagctggaattacaggtgcatgccaccacgcctggctaatttttgtatttttagtagaggcggggtttcactatgttgaccaggctggtctcaaactcctgacctcccacctcggcctcccagagtgctgggattacaggcgtgagctaccgcgcctggcctacagtgttatttttaaaaactagatactatatgaaatgcagacatgataaaggggtgcttaacccttttaggtgacctgcctttttaagaaaattgcaattttcataaaaaaagtatacattttaaaatagtttagtcattactcattttgtaatttattttatattgattttcccctctgagattcaaatgtttgtaaccattgctgtcttttttacaggtctctcttctttatcaagttatcatatttgggaacaagtgtaacatggtagaaatgaagatgtctcttgcgtgggaggctgatgctccaagggaaccttgggcaggatccatgctttctgttaacacaggcttcatctaccctaagtgctcaggcagcgtttggagaaggaagaaggatgactggaaggaagaaagttacttttttttttttttttgcagttgtggggaaattgcactgattcacgcatgtacttttctccagtctccccggtcacgaacagagcgtaattgctgcacgtctggccagaacaaacacttgagctggaaataccaaactgtatatatgttaaacacaggctagttttacagaattttcacctctacttctcaatacaaaacctgtttttcacaactagcattacccccacacgcagaaatttttaaagaaaagatgactaggtctattctagaaccttttgttattcctggcagtagtacaatgaaattgggtctagtggtatttattgttggggtggatgtaactcctattgaatctgaaagcacagcatcaagtgaaaactgctgaacaaatgctaagcatagaaactcttctgtttatgaactttttggttttcaataggctgccctgagtatgcttttttgttcttaattgaacacaacatggtacaaaaaattactacccctggccgggcgcagtggctcacgcctgtaatcccagcactttgggagaccgaggcaggcggattccaaggtcaggacttcgagaccagcctggccaacatagtgaaaccccgtctctactaaaaaatataaaaattagctgggcatgggggtacatgcctgtagtcccagctactcaggaggctgaggcaggagaatcactcgaacccgggaggcggaggttgcagtgagccaatatcgtgccactgc

SEQ ID NO: 1150 - DNA, 1651 bp, Homo sapiens
caattattgtggtttcactgaaagttttcttatttagttcctagctgtacctttgcccaattcattttctttcagaagatgaaatcaatacctgagatgggaccagtacatctgtttaatggttaacaatgattaccctttttattcattcagcagttaccattgttcatttttttttttgggtgagacaaaagttcgtggagtaagaattatttgctttctaaaggtagatcattaataaagtaattgagtaataaaataattgaaatggagataattaaacagccataacctatatgcaactattattaatggcaacctgaagcattatgctccatataaatcataaaaacagaaaaagtttactcactataaagaccataaaccggatatgatataagtatgtgtttcaggttttataactccatatatttccaaatagccaaagttcaagaaactttgacttgctcctggaaaccacatttcatcttttctggaggaagcagagcatgaaattttcccgaggctgagcagatgaggagtttcctcattattaggacaatatagccattggcatagcaggtttatgctgttgcctcattagatgccactgagaaaactgaattaagagcaaaaagtgagcaagtccaactatggtgattatgtaaagagacttccagatgtcttagtactttaaaacaatgcttctcttattcctaaaatgtccaaaagtgctatacatatatctttgagagaaatcctataaatgtaatatttgttgcaaataatagttgcaaacaggcaagagagcttctgtgtgatgcaagcaaagaggacaaagcaaaatctcaaaatttaggagctggtgtttgttgtagctcagggagaaatctcagcaggtcatccagtttattagccagcttctaggcagagtggaactgaatgtgtcctatatagaagagcattgtggttagaaatgtcttcccttgtgaaggatttaaactaaaatgtgcccactaagagaaaaagactcttatttttccctcaagacctactttgtaataagatcttttatgtatacttttagtgtttacatgataattgccccccaaatccgacatatatgtttcacatgtagttacattccagttgtgataaaatagccacaggaactgagaggatactttatttttattagtgttcctaatgtactggctcaattcttctccactgtagatggaatgaagtttattgctttaagcaaaattaccagtgcagcaataaattgtcatggttatatgtcccgggccttcttgtcactgattcaaatttacttctgagctcctcattttctaaggtaaagtcttctataaatacacaggcatttcatttctccttaaacactcaatcaaaatgggatatctttctaatgatttgttaacagttccataaacaacttaaaagtacaacaatcagaaagaacataatcctttctaagcaattgtaaaaccaagtagaaatctgtgtgcatgttcattcttttattctttcaacaaatagctactgatatggtttggctgtgtccccacccaaatctcatcctgaattgtagctcctataattcccttgtgttgtgggagggaccctgtga

SEQ ID NO: 1151 - DNA, 1451 bp, Homo sapiens
ggctgggcacagtagctcactgtgtaatcttagcactttgggaggcagaagtgggtggattacttgagcccaggagttccagatcagcctgggaaacatggcaaaaccctgtctctccagaaaacaacaacaaaaacaacccaaaaagacccgaccaaaaccaatatacaccaattcacctgccattactcagtgcagcaaattccaatataaactgacatgcattcaggcaagaaagtgttcaggaaagtgcagattattagaagggatcacctgctaagaacgcaacagcattttacagcaacacggcatctataagtgtgtgagaaccagataatttttgaaaaaaaacacagaaatataaacgctaaaaaagagtcagctcttcaagacaatcttccaagcatgcccagaatatgaatttttcttctcagaaaaaaaaatgtgaggatccatggttttctccagtgtgagtgaagaagaaaggtaagtaggggaaaaaaaagctagagggatgggaagcagctaaatgggaagccctactggttgaacatgtgctctgtgtttttgccagtagagtctagggggtaaaggagtgagaggactctgtgtggcagcatagccaatttagtgcagacttctcacacagcaggaggtcctaaacctcatatcaccaacagtccaggtgggagggtagccttggagctgcagaggtttgtgtgatttcaacatgggctgtacagggctaatgcaggaagaaacattgatttaaaaatacgtgctttttgccattgaggattaaacaaatatcttcttaggatgacaaattgcaagtaagaaattgcaaaggcaatggctgaaaataaaataacaatagtttcaattatcaatggagaggaattgaaactataaagaagaattaggtttttctaaaataaccagaaaagtcttgcagtcagctagatgagaacaaatactaataccactattactattactctttttgttgataatgtattagtctgttctcacattgctataaagaaatatctgagactgagtaatttataaagaaaagaggtttaattggctcacagatttatagggtatacaacaaacatggcagcatctgctcagcttcttgggcagcctcaggaaacttataaccacggcagaaggctaagggggagcaggcatttttacatggccagagcaggagagaaagggaggtgccacatacttttaaacaatcagatcttctgagaactcactcactatcacaagaacagcatcaaaaggatggtgctaaaccatttatgagaagcccgcccccatgagccaatgacctcccaccaggtccctcctccaacactggggattacatttcaacatgagatttgagtggggacacagatccaaaccttacaaatatacatctagaaggcaaccaa

SEQ ID NO: 1152 - DNA, 2759 bp, Homo sapiens
agttggagttttgctaaatattctggagaaaacatgacattttctcataaaatactgaagtaaattttaaatgcattagagacttaaatgcataaaattaattcatacatgattagcataatagaggagaatatttctaaactcttgatatatagaatctttcagcatgaaacacgaaaagaaatcaagacctcaatatgtaattatggactaaaatataacatatggaaaacaaaatacttttgtccagatttaaaaggcaaatgacagtggaaaaatatgtgtaacctatggcagataaactgttatatacttaaaataaagggctatttcaaataaagaagagtaaagattagcatgaatggtctcataaaaaatcagacaaaggatatgaatagagagttcataaaggaagaaacacaaccagaaacatatttaagaagtattcaaccttactataagtctaagatctacaaatttaaacaacactaaaatgatatttttgaccactagaatgacaattctcagtatttgtgtcaagacaaggaaataaatgctcctgtgcacttttggtaggagaaaatatcggttcaatgtttgtttgttttttctcctcttagagagtaatgtcgaaatatgtatgtattctcctgtaccctgggattctatttctgcaaaattatactaaaaataataagataagtacacaaagatgtaaatacaagaagattccttgtaatgttgtttataatggggaaaagttctcaactgcccaaaagttgaattgtggatggaacttttaaaaaatcatatttcatataatggactatagggcagccagtaaaaataaaacagaagctattccttgatgtaaaaacacatttatgatatacatatatttttaagtaaaaagtaaattataaaatagtatgagtggtatgactccttttatattcaaatatgtatgcatatacactatacactatatactacacacacacagaccttcaggaaaatttctggatatcagaatgtatcaaaatcttaataacagttacctcctagcagatcaattttcagtggtgggattttttttccatagtcctatattttctaattttccttctatgctttttttactcatgggataagaatatctggggaaaaaaaacccgggatgcttcccctaatattatttttgcctccactggtgagtataaatgtctgcgtgtgtttataagcaaaacaaagccatctgcgaatcatttttggagtgagcccacttctcagtcccaagaaaagccagaaggaaaacataagctgtgacactgataaatagaaggaaaatcagaagttgcttttcctacacttcggcttttgtcaccttcaccagtagcacagatgaggctcccctgggatggcttagggaccaaggctctgtgaaattctccggggcttgggaggtggccacagtggcttagcaggggagaggtggacacagcaagatgctctccagtcaatgataacatatgtttttctttggcttcagagcccaccttcttctgtgggtacttgatatgtcatcctcttccaatttgcaatccagagtgacccttaagcttttgttggttgagcaaaactctaaaaacatagactttgtcttactctctacatttcaagatccctgggttctgttggaaaagcaggggatggaacattttgtctccggtggtttagtttctttcacctgtactttatctgcctacgtgtcccaaagcctggggaacagaaagttaaaagcctgagagataaattaatcaataacaaatgttttctaagtctccaaaagaatctgataaacatttgagaggctacgctcagcacatacacgtacaaaccacatttcacatctgtttttgagattcacaaagtccttgaagctcataagggggtgactttgaagaaggaccccaagttaggctggaacccccaatctaggagtggctcctcctgttcggtgttcagtggccaccaagatttctggagaagccagtcctgccccgccaatctcgcctcccatcccactctcccttgacacttttatatcttgcaataaaaataaatatggcagctgaaagcagcatctacagaagacacacctcttccttctttccatcttctgacttttattaacccatcacctttctcaagtgttcatgtaatggctcatttctcatgtttcatagtcctagcctgggaaaggtacagtaatgatagtctttgtaagtctagacgccaaacaaccatctcagaaaagcctcatttaatgaggctcacacaatgggttgttttaaaatagatcttcatccaagccatgcctccttacattttgtaatggtgtttatattttgcaatattttattcatgatggatttgggtttttttaacatctgcaatctcgggcactttgtggtaaatttgaaaactcagtccctggaatcacttgcctgtaaacccgggtgcacagatgcacgtgccattcaggccgtcgctgtcacaggtggctccgttcagacagctgacgttagcgcagggatccttgtacaattcacagtgtgttcctgcagagaaacaagcaaaacaggatgactcatccaggactctctggctcccatggcctctgaaagcaaagtcggaactctctggaacaatgcgagggagattcccagcgtgggtgtgtgtgggtgagtgtatacaca

SEQ ID NO: 1153 - DNA, 4772 bp, Homo sapiens
accagttcttctgcctggacttctggctggagtgatgcatcagatggttccaaatgggagccaccagaaagcacctgatggaaactaaccaaatcctgtccctctgcagatgaagccaacaaaggtcacatttgggcaggaaaataaaagagtcaccccggcagagggccacctggcatcgctggggagaagtgactgtccctgaaatcactctgtattgtgtcaagtgctcaaacaaggacttttcttttgcatcacagacctggaaaagactcagtgggcaggattatccaaacatccgcctctgtcccatatggcctggataatggctcctgtctgatatttcttttcagcaggtctgtggcagcgagaggggcccaccaggcttcaatggcaacaacatgcccatggggtaactaatgggttgaaaggattgcacagcactatctagacaacaaaatgcatctgcccaaaatagcattttgatttaccactctgcaaagtggcacacagaaaagtgaaaaaaggaagcgatgtatgaggctgcaaagagtttctgacaaacaaatgcctttgggaaggccaagcagagtatttcaatcaagaagttattgggagcaaatagacatccttaatgactattacataaattgcccagggtcacgtgtaccagggtgatggtgttcaccactagtctttttgttcttgatgtttctttggttttttgtttccagagtttgggacctgtttatcccatagcatttgccccaaataaatgacagccatttgggagttgtgggtcccctatgtttgtcactacccccaatgcattttctgacaagggtagtgtcctaaaatgaaagctgagatactttcatatagcttaatggtttcaacaataaaaccatgttaagtttatgattaaaaagataaaattttaataaggaagaaaacaaggaaggatagtggtaggtttggacaacagcaaggagtgataatttgctttcagatagtcatggtatcaacaggctccacccttcaccagggaatgtgaacaaatccattcgttaatttggccatggagggactcattggagatttcggggcagtgaccatgtcagagaatttatgctatgttgtagctaacaaaatagatgtgttgtagcattcagagcttttgaagcccaaatcttgccaaatagtgtctcttacttcagtgatacttaaagcattatagagattgagaaaatgttgagatcacactgtcatgactgcatacaccaccattcagacaggaagcgctgaccaccagtaggattcacctaggggagatgttaccatttcaactgtctcaaccttctaattggaggtcttcatgaaaggttcactgtggggtgatgtaggctcatgactctgtcacatgaccctaacttaatttgccttttatacctgctcaaaggaacgattattgtcagagaaactgtgtgtatcacttcgcgtcccagaaattcaagcagcagctcctaatattttgatccagaaagaatacacataaaatattcttttatatatatatatatatatatatacacttatatatatatataaaagaagacatatatataggtaagtatatatatacttacctatatataggtaagtatgtgtgtgtgtgtgtgtgtgtatatatatatatatatatatatatatatatatatatatatataaaagaagacatttatgtggccaacaaacatatgaaaaaaagctcatcatcactgatcattagagaaatgcaaatcaaaaccacaatgagataccatctcatgccagttagaatggagatcattaaaaagtcaggaaacaacagatgctggagaggatgtggaaaaataggaatgcttttacactgttggtaggagtgtaaattagttcaaccattgtggaagacagtgtggcgattcctcaaagatctagaaccagaaataccatttgacccagcaattccattactgggtatatatccaaagaattataaattattctactataaagacatatgcacacctatgtttattacagcagtattcacaatagcaaagacttggaaccagaccaaatgctcatcaatgatagactggataaagaaaatgttgcacatatacaccatggaatactatgcagtcataaaaaaggatgagttcatgtcctttgcagggacatgaagctggaaaccatcattctcagcaaactaacacaagaacagaaaaccaaataccacatgttctcactcacaagtgggagttgaacaatgagaatacatggacacagggaggggaacatcacataccggggcctgttgtggggttgggggcaagggcagggagagcattaggacaaatacctaatgtagatgacaggttgatgggtgtagcaaaccaccatgtcatgtgtatacctatgtagcaaacctgcacgttccgcacatgtatcccagaacttttatgtatacatacatatatatatatatatataaaagaatgtctatgtatatataaaattgaaatgtaaagtagtttttttccaattctgtgaaaaaagttaatggtagcttgatggggacagcattgaatctgtaagttactttgggcatacggccatttgcaggatattgattcttcctaaccatgagcatggaatgttttcccatttgtttgtttcctctcttatttccttgagcagtggtctgtagttctccttgaaggggtccttcacatcccttaaaagttgtattcctaggtattttattctttttgtagcaattgtgaatgggagttcactcatgatttggctctctgtctattactggtgtataggaatgcttgtgatttttgcacattgattttgagaatacacattcttactacaacacaagaatataccttagaagtagctgagacatagaaagaagaaatgggaaaaagatcataacattttttctaaaataaatgtcgtccataacacacaggttgagggttcttgctcaatgagtatgagaacacaggaattgtccattccagagtggttataatcagctcaagcacaccaatccctgtgcaagctgcagagagtcgcatcagcatcctgccttcagatcaaagctgctgagccagactctggtggaggaagggccccagaacaccctgcatcactcagaaaccattcaagttctggaactgctgttgcagcaatcctcaccagacatcaggaaatcatggttatttgtggacagaaaaaactgaggtcattcaaaggatccaggccagattcccgagcatgatgtggggtttgaatggccctgcaaagagccacacattcatagtgggagctgattccagttgggttctatcagggagaccccctcactgtgtctcctcccaggccgaggcaaacgagtccctgccttctcacaattgcacctgtgtgctcacaaggctgcgtgtgatgctgctgtgaaagcactcccagctaagtctattcatcattgcacacggtgggtaatgaagacctcggaggaaactggtttccacccctggggaaatacatcaggagcattcaaaacaacagactagctggactgtaggaatgatacagattttccttggggttctccatgaaactggaaacttataaagggaagatgatgttattgcattagccactcacatctaaataaacaggaggcaacactagttctggggtaagtcaaaactttgtctataaatgcatgaagagaaaagtgcttacacttaaaaatgcaggaatgggattgtatccaacactgtgctgtccaacagtaccttctgtgatgatggaaatgttgtatcccactccgtccatagagtagccaccagccaatgcagctacagagctccgtaaatgtggctactttgagtaaggaactgaattttttattttacttatttgcaactaatttaatattagtctaaatagccacaatgggctagcagctaccaaattgacagtataggtctagtgtataatttcagtgatgaaaaaagacacaataagacctggaaaaatgtgtgaaatgtcagtagtggtgactgcagggagggggaatttttttctgctttttaaatactttttctctatttccaaagtttttttattaataagcacatataaattttataatcagaaaaagataaaaataaatgtatgctgaaaatattaaaagaaggacaagataggacaacttcagcggttcctgtatctggcaccaacctgcttgctcaagctgatcaataaccaataaatgatgaaaacattgctgttgcccaaacagccatcactcatcaggaggctccaattcaaacctgtccaaagtctactaggcgccagccatactcggctttcccttggacacctgaatatgccaagcttgtcctcactcagggctacctaagctgttcctcctgctgttcctccaaatctcctctagctgcttaaaattcccttaaatgctgcctcctatccaatgtaaccagccagtcatcttctatgtcatcacttcctttaattgtccgcacagcacttctcactacctgctattttcttgtttatttatttgtgtattatctgtctccctccacccccaaactagaatataggctccaagaaagcaggagtcttgtctgttttgttcactgtcctatgcccaccacaaagcacagtgtccacaacatatt

SEQ ID NO: 1154 - DNA, 10143 bp, Homo sapiens
gccggctcacttagtatgtgatgttacctacagaattcttgctcttcccactctgcttcttccatgcctcgtgacactggggtttcttctttttcatcttcctcttaaagactattactatcttctcctcacagcttcactatcctatccatctgaccttgtctttgacacatcagcctcatttttgctgatcttctgccctcagggatgatgtctttggttggcactgctttcctcctggggtctctgtcacatttgagccatttccttctagctctccaggtcaaggagagcgtctgttgtggtagacagtgccatctccacccaacatcagacacttcacttctgtcttcccaccatatcatgagctcgatcactctggacaaggaaacctgagatggggatgccaattcaagctctcccatcatcatagatttcaagggtgtttttaaggttccaaatccctgttttgactctcattttatgcacgacactaaaaactcagaagtgaaagagggaaggagtagaagccaggtgtaaattcccacctctcacaactctgggcagctataactttgaagacccactctcttcttttcataaatataccacctttcaccaccaccccagggtggaagggtgattacaatgaattttttttaatctacattggttgtaatattcaaagaaaaggttctatgaagcatgatgtaagtttcaaagtgttactgtctctaatacgcaggtgaaagacaaaaatttactttttagggtttagaagcaataccattatcacattcatcttatcaatatgtttaagttttttgaaagattaaatggatagctaggtgcccatgagctcatgattgttctcttacagatggaagataaacctgaactctgactttcatattatataggctggaggacttactctcatgttctgtctaaagctttatttaactgatggtcattgtactcctttgcagctctcagtacatggggaaagaagtttgttgatcctaacaaagcataaattgcactcatatttgctcttgttctaaggccaatttgggacttctaaacatttttaatgagctttgtacacaaaatcacatatgtcaaaactcatgcatgccagaatttctcatccgaaaccatgcatggcagcaagcaagttgaagcacgtgtcttccagggcagtacacagtggcagccacttgctaccccctaatttactaaaaaaccctgggttagtgtccccttcgtatttcccaacagctttcccagtcgcttctcgattccttccatcacttagtgaagacactacaaatacctccttcatgagattctgatgggattctacatgccagggttgccagagaacccatgcatcatgaattcttcaggaaggcaaattgcatctagagtccctcaagttgttgtatattctgattcttccccataaaaaatattttaatgcagaaattagctacatatgaagttattaaaaaggtgtcctgtgactgagggaaacttggagaagtcaggtaagtatagtcaaaaaggtttggcagatgaggttgaggaagccaacatgcagtaataaccaatttgtgtgttgcaaaagctagaccagtatttttccaccattagcatcaaattctcagaacccgccctatatgatctcatgcataattcacaccttagcaccactaaatcctgtttcctctggattttagagccttagaagaaaagtacatcaactcatttcagcacctatgggcagtataccgtcacatgactttcctgtatttacagggtataaggaagtcataataaaagggggaagtgattgacagaaagatacctacagacagttaggacataaaatgtatcagataataaatacatctacgatcttccaagacagatccacaaagcaggagatctcactacatgctgttgaacagatgtgaggggcttccccaatgctccccacagaaacactgatgattttggtctgacacacgtgtatggcatgagaaagatcccgctatatgtgagaacaacccctttttaatactcacttacccacactcctcccagaggccctgtagacagagttataccattgttcacacaccagggactaggaccagcaccacagcattcccctaaatgctgcctcagacctgcctgaagtttattcttaaacaagaatattagaagagaaaagagataaaataattactatagtatttaaagatccaaatcacctttaatgataatttctattatagttaaataattaattttcaccttttgcctaagcaaaaaggtatgtaaggaaagaaggagctcagcaagtagttataatattactcttaacattttttaaacatttatttaataggaaaatgttattgcaaatgaactgtaatgtgaactttcaacttcacttgtacaaacattatctttggaacatatttttctactaccctgtcctattccttttttttagattgaaacagaatgattatagtcatttgccataatacctaacgtcgtctgacagtttaaaacagtggtctcaaaaggtatgtcataactggcacgtcctcaacagtaccttatcgttctgtagctcatctcagtagaaatatcaagacctatcaagccactaatgccttattctgcctgtctgatggcccatttggtatttgacaatgccaattcctctgtcctcacatttactgttgacttttctgcatttgctcactgggattgtcattcactctaacctgggcttcctcacatagcacacaaaatgttaaccacatgtcctaacatctttcacaccaaaactgaggccaattccaccactcttcaggagcacagtcagcccaagctttctcacatgagaaagtggagtgactcacttctaatcaagagggacatggtgtgtaagtgcatataattacatgcagtaaaagcaacctgactcatttgaaaaaggctataaaagttgggtctctcccaactgcaaagtaccagaaggtatctaattcaagcccacacaatcatgaagtagtaattctgaattcatttaccaaatcctaaaatactggaataaggcacaccctctacaactcaaagtataagacaaataaaaggaaggcaatcatccacagaggaataatggtacaaaactcattcatctcaacatatggtcccgggtatggaataaaaggtgacgcagaaggagtatggacacatcaatatgccactgagtcacggatggcttctcagaaagacctaacctgtaaagctgcatcagggaaaaaggtttccctccaaggtgtattctttggggctcccattggccaactcttaattggaccatggatctcattcttattggtgattcttatgttcctaccagtagactggaagtacctggtaattaataataaccagagaagaaccactgccccccagatgcctgtggagtcactaattttatcattccttgaagtgcaggtatcacacaagtgcagaatctgatgggccagcaatttggtctcaacactggaatgtccaatggcaggctagagcctggaatttccctcacaaaagcaggcaagcaagctcttcatgcccttttaagcagtgctatgtgttggtcatgcaaaatcaaagaatcagaacatccacttactttgtaagctgtttgacaaaactaatgattgccttttcatacaggttacctttctcagcaatgtaatttctcctaaaagtaatgatcacataattctctttcaacaagtatctaaatttgaaaaccatatagagaacagttccaaaagacaggtatatattcaatcaactgatacttttttaagtcctactatgttctaggcactgctatagtaattatggatactgatgaagtctgctttcatgaagaggctagctttggcaggagatgggagtggagaggaagttaatcaaggaattgcaaacaacgtaaaaccacaacagatggggtctccaaaggagaggcatatatggggtatgctgataaaagtttaacaaccagctctctgaggaagctctgatttgtagactctgccaattttcattgtgtaaacactcccagtatggccaataccaacatgatatcatatggcctgcaaaattcctggaaatttcacaaccagcaggtacaagactagtataatctggctccagaacaccacttatataagaagaagctgagctagaaaaggacatggaatgcttgagaaacaatagaccaccccaaggttctaacacttaagtcctggatctcaaacattccatccctggcaccaaaatagcataatggtggactggatgcacctggaaattaataataaccagaaaagaaccattggctcccaggtaaccatctacttgtcagacatggtgttactcctttaagccaattatgctcaaaataaggagtttgtccctcctagaaaacacatccaaactcacaaaatagtttcatttaataataaattccccccttgtcacccacaccaccaaaaaacaccaacattttttcagtcattcttcaagtaaattccatatcctttgctatagtcacccacctcagtccctgagtcgtgggcagccacacaacaccgctcaagggggcactcgaggagaatgaaaacaacttaacaatagtatttctctaggaaatactattctttcaaagtttgtgaatcctcaccccaaaatctcattcaaattcagtggagttcatttaataggttaaggaattgtatacctctgcctaaaacacacacacacacacacacacacacacacacacacacaaatgtatcgtataacatgtttataaatttataaaaacataattatgtattttttaatttagtaaatgtcatctcaagaactagaagcaggcacaacagattgccagatcctctgcacgtatttcagagaaaaccatattaaaggtttgaatcaaatgaatagaaatcatttgaaatgtaagcaagagggcatatggggagatggcacccaagaaggcaggagagaattccaacaattttgagcctgaaggccaccgctgaaggctgcactccatttagaagcataatgacatttgaacaggtgaggacacatgtgaaaactagttcacaaatttagcccacaatctctcccaaactccagtataaaattcagcagacgataggctgaaacttcctaagaaaccttgtacatagaatgttttaattaaaatttgatgaatatgtattcagctcctaagaacttcagaagactcaatattttctgattagtataactaagggtaactttcatttgcctagtaagtttgcttctcaaactgtagctaaatatttcactgaggttttcaaaatactcacaaagagcccactgatcctgcttcttatttcttcttactgatataatcagctaagcaaatggcatcttaaaagttaaactggttacttcatctcataatcacataccaggatagaaaagataaagggccaggtgcagtggctcatgtctgtaatcccagcactttgggaggtcgaggccggcagatcacctgaggtcaggagtttgaaaccagcctggccaacatggtgaaaccccttttctactaaaaatacaaaaattagccgggcgtggtggtgggggcctgttatttgagctactcaggaggctgaggcaggagaatcacttgaacccaggaggcagaggttgcagtgagccaagatcgtgccattgcactccagcctgggggacagagcaagagtctgtctcaaagagaaaaaaaagaaaagataaaggaatgagagagtgacagtgagaaccacagcaagaagtcaagactggttatcagcaagggttattgctttcaacaagattgaactatacaactgtaaagatggacaaaaatttccaggaaaactaggaaaacaaatttattttgtaagatagttaattatttaacatattaattataatttaatagcataaagtttgacttttgccacaggtaaacaaattaataaaaatccacactgatgacaataactccatcaactgaataccttctatgcagtaggcagtccagttggtggtttttacacataacttatgtaagtctcatgcccctacccccctcttagatatatattgttaccccattttatggatgaggaaaccaaggctcagcagatttcgtaatttgtcgaagatcatgacactgcaagtcgttctgaagtctgaattccaaagaggatattcttaaccttgacacgttgctgcctccccaccaactagagctcttatcaatagttattcagcattcaccaagaaatcatgaagtccataaattgtgaatgtcaaagaaaatgcacagtaaagaagtccacatttttcccagtttacaaataggctggttttaaaatttgtttagaaatcaaagcacattttcctgaagaaaaaaaggaaagaacaagaaaggaaagaaaacaaaataattgggttatcaggtcagttcagaaaagcctaattcctgatgatgatgacaatgatgatggtgacgatgatgatgatggtggtgatgatgatgatggtgacaataatgatcatgatggcgatgataccagcacatgtggccaggcactcatactaagtactttacacatatttaataacatacctcaatggccatagggtgccagaaatgcatctcttgactttgtgcagagattttccccaggagccaaagtagggatgggggctgggggctgggggctagggcatcatgggggctgtacagcagggacaagggcaacatttacaagtgggaggaggttgccttcatgggcaaacatttgccttcctcctctcctgtgcagagcactgtgttaggggctggggagagatgaataagacacctaaggctggtcttgtgggagagctgatactgaaaccctttcaacagtctgaaaagtgcaatggtaaccattttccagatgctgctgagaacaggagatagtacctaccagagtgtgtgtgtgtgtgtgtgtgtttgtgtgtgtgtctgtgtatgtgagagagagagagagagagagagagtgtgtgtgtgtgtgtgtgtgtgtgtgtgtgtgtgtgtgtgttggggctaaggaaaggcacagtgtcaggcagggcttccaataggaggtgatggctgagctgaactttaaaggatgagcatgaaattgatgataggaggagctaggggaacagatttaaatgtctgaattctctcccgagcacccaccattccaccccatccccctcttcatcggctcttcctcctctacccggatttcaaatatttgtttttccttctcttctcactatacatgctcaccctggacaattgcacccactcccatcctttctctttccatttccctctggagatgtctctgctgagctccagaggaacacctccaactaagtgccaaacatctcatcgaaatgtctgctgggcccctcagactttacgtacctcaaactgagctcctgtcttcccctctagagctggaaatttaccttgaatttaccgctcatccagtgagtgacagaagtattatgagtgagtggaatttaccactcatccagtgagggggcagttttcttggaggtggacagacctggctgtactttctaccataatctgcggtataaattcctatcaaatctggtcttcatgattagcacctatttatgccccacagtttacagcaaaaattagaaagcagtatgggctgttttccaaatgaaactaatttaaaataatttacttttttgaagaattataatgagaatcagtagttacagataatttcgatgaaagctaatctcatgacctagtaaaaataaagagactgagcatatggtttggaataaatgcgattctctaaaatgcaatctggataatcactgaattattataatcattctcaggcatgtttttatctttgttgatttttttccatccaccaggactgtggtcgtataataataacacaacaagtttagaggactctgatctttggttgcttagcaacttgcagctttgacgagaataaaggataaagggtccatagcaaaataatgctgtttgcaattcaacagttatttaaaagttttagaattattaaaactgttctgttttaaataaaactatgcaaatgaataaatacttcacaggatcagtcatcgtttttatttctatcatactctgaatttgtggttggagtcaatcactgaatggatgacccagatttactaatttgaataaaaatatgatgagaacactgtttaacatggcagagtcattgttccttccatagcagagctcataatgttgctgggaaaactaaatggaaaatgcatttaaattacgaaaggtaaaaggtggtgcccatcctatagtccctgctcagtaaacgctagctgtcatcatcactatcactattatcgtcattaaagagaaatggataaacgggcctgtgtagagaattcagcaaatggcatgcatcctacaatgagcattcttccatttcagtggttgcaaatgtcagttagcatgttcctcattccttcatttattttttattcattcaacaatggtcattgagcaactatagatgccaggtgccataccaggcacagagcaaacaactgggaacatactagacaaagtgcctgtcacggtgtggacagatagcaaacgagtaaacacatcaatgtaagtcactacaagaactgagaagggctcaagcaaggggctaaggtcagtgtgaggcatcggaggagggctccttcaggaggggaggcttagtgggcacctgaaggatgagggtgacccatgcatgggtagagctgaaagaagagggagtttttcgtgacaggatgtgcaaagggcctgaggcagaaaagagcccatatgtttgtgctgggtgcccctctgagaatgggatggacaaagtgggctggggtaaaggagagattggagagggagctggatttgtgttcttatgaaaatattattttcatactttgccagggcctctcaaagtcacatttagtcaggcaaatacacccacatttgcactccccacagaatggaggccatgtctatgggatggtgccactgactgttcatctggcacagctacagccttgcccccactcccagcccgcactaccaccgtcaccaccgctgtcaccactgccacccagtcaacctgcacccaggttctgagtcagctttcaccatcattaccatggctgtcctgggatgctgcagcatggtggactctggaatggtccaggaaagacacagctctggccaacctgacttagcctgggggctagagcaggcagaaattctagaaattcaaacaagccaacagaggcaaaccccagagactttatgggctcacacctcatcctgactccagccctccctcagggtggctcagagaccaccgcaccccatctctgacctatctagcaagaagccctacccaggcctgtcttctgctgctcctccatgagctgactccagcctgactccagcactcactcagctcacaaacaaatcctgctgatagaggagtgactgttggctgaatgccatattgccatcccaacagtccagacacgaacctcctgactgtccttaaaaccgtaagccaaacaggtggctttaattgtagaaattcccatcaaaccaacatgctagggaagaggagtcttttgtggacttacaatcaattcccttcacatcataacacaatgtgtacagaaaaactgcaaatgaagccaaaatcccaaaatctttacataacttaaaggtacaagacttgacttttcaatgtcactctgtcaaagattagggtatctttctttccaattttattttatgcaccttaacataattttgattatagcactgatcaattttgtgtcttcttttttcttttcatataatttcatagatgcaagattgtctttaaaaacatcttt

SEQ ID NO: 1155 - DNA, 2279 bp, Homo sapiens
cttggcgacagatctggtgaccaaataatgcggtgactgagggcccttggtcaatgattgtccccgtggctgaagatctgagaggcccatttccatgatcaccacaagagtcttcatggatactgtggtgccgacacacctacaagtattttagtttatttaactgatttatatgagactttcacgtaattactagttgtttgcgtgtaaatcatttctaagatattttcttcaatttataaatttttcttctgtttttatgcagatttaatgcagtcgaacttttctttctcttttacattgcaatatcaacaagtaagtttatttggtttggatttttatatttaacttttgaatagttctagaacatattttaacatcaggtttaaagtttggcatacatcgttttaaaattccaaatcatcagctaattttcccccaacagttggttgaacaattcctcccttctttattgattcaaaatgccacttttatcgaatagtatgtccttatatataagtttctctgatataagctgtgtgtcatatctgctctttccccagcatctcacttcacacccagtggtagctccgcaatcatcttccatgacctgcatgcttgtgtgagcagaacactgcgaagtacgttacctgggcatctcatttaattcccacaatcagcttacactgtgagctcttactgccttcatcctgtagacaaggagtctggggctcatgggggacagccgacgtgcaaacctcatcgagccagcaagtgtcagcagtgtccagccgagaacagccgcaactctcctgtcacaccgttcacatctctacatgcacaagcatctgcagcctctccattttgtctcccagagcagcatgttctgcttttagagaccagcagggcactcaggagtaactggttgggcaagtcacatctttcctcctcctcggcctcctcctgcatctcctctttctttctcagtgtcttcctgagtgggcgtgcactcgactccggtgagctgggcctaaacaactgagctgtcgcggtgtcttcattccctagggctgctgtaacaaaacaccagaaacctgatggtttaaaacaacaaactgtcccacagatggagcacccaggagcctgcaatcaagaggctggcagggccacgctccctctgggggttccagggaagaacgggttccattctccaggcttctggagctacaggcattccccggagctccttgactaggagatgcggcactcctacctccgcctccgccaggcatggtgtccgccctgtgctcctctaggcatctctccttctctttcaaggacaccggtcctattggatcagggcccaccctactccagaatgacctaatctgaaccaaatacatcaagccatgatgctattttcaaagaaagccacattctgagaggttccaggaaggacaggaatgtagggggaaaagccctattcaaaccctgtatgtgccatattgaaatatagtatgaaaagtgtgtaaacccagctgccgtaggtcaattcctagtcctcaatttcccacagaggggagaagcctgcgcctttctctccaccccactgtcatgtacctctctgcagggtgagaccgagaggaggagggagcctgcgtgggccactcagctcctggggtgctctcgtttccctcctcatgcctataaagaagggagggggtcttcctctgtgtccctgcttccctgtgctcagcatggtggactcggaccccaccagccttctggaagccctgggtaagcaagtttgctcagccaaccccaaccctctctggtgtcattgtcctgtgcttctgacaaaggccaaggggtttggaagccagtctgtggccccaagtaccagttcagttctcccagccagcttttgaagtagaaagacggatttattatgtccgtatgtctgaatcctctgtctgcctgccaactggtttgggatttgacagtgaactaaatggaagaggtggctggaaaggattgacatgtgctggtcagaattcacgtgtggagagagaatcctggggctgggccagggcagtggctttcagcattactgctttaggaagctcagtcccctgaccttggtagtatcagagggatggggctgaggctccttagtgacaggcgaggactccaatgagtctcttgcccaggtttcaccttggtctgacttccccaggtccacctgggccacagcagggactagaaaacctgagagtctc

SEQ ID NO: 1156 - DNA, 8172 bp, Homo sapiens
ggggacttttttaaagatagaaagcatcttgactatcctagcttcaaattaggaataggtagtacagtataaaaagatttgtcaatttgagaccaacctgggcaacatggagagaccctatctctactaaaaaaaaaattcatttaattagctgggcctagtggtgtgcgtctatagtcccagctacccaagaggcacatatatttgaagatttgtcaaatatatgtgctgcttctccaactggaaataaaactttgtgatgttttgtgttctcaacattagaacgtctgattttataatgtacattttgaagcaatacaggactttttttccacatgactttatacaactcttgggacaggaaaatattcactttgtatttctgtggtttgctcagttccacaacctaggaacccaacaggttaagaaccgtcaatcatactgcctccctggtgactttgtcaactgttagaataacattggtcaaatctttttcatttcctccctcacttccttttgtagattttataaacacatgcaaaaaggcaaagacctaaaggacttaatttttttttttttttttttgacacagagtttcactcgtcacccaggctggagtgcagtggcacgatcttggctcactctgaggttcaagtaattctcctgcctcagcctccctagtagctgggattacagccgcatgccactatgcctggctaatttttgtatttttagtagagacggggtttcgccatgttggccaggctggtcccgaactcctgacctaaggtgatccacctgcctcggcctcccaaagtgctgggattacaggcatgagtcaccatgcctggccacttaaaattttggggggtatcgagaagaaagaaaggcatggaagaaatgagtgttggagaagagtggtgtttaaaatgaacaagttgttacaagatggttataacatggctaggtcgagagacagccagagatgggtgacagagggtggggtgtggctgagcaagcccactgtccagcttctccgttaggatttgtatgttactttggttttgcattcttaaacttctttcaatgaatatatcatgttacatcttggctttattatgtgacagataaggttattaacagaaagtgatattaatattaattatacaatgatactaaaaattttatatcacacagaagcagatggttatttttaatgacttaaaattttactcttttatatgagaagaaacattttaaacatatttagttataaatgctattttaattgctacattatttctgcagcgggatttttaaaatcttactatagttgcagggaaatatttctatgtatatttcagatcctcttaaattatatacttatttacaggaaacaattataattacattgagaaaacagaatggggggcttcaaattatcgataaatacatcacactattctcacacatgatcattccatctggtcatagttcaagaattcagctctagtaggaggcttactctctgagcattcatcaagttaacaaccttaccagttatctttttaggtactctatttttgtaatgtttgtagataaatagtcctttgctggatttttaaatcataactgggtaagcatacgacttaagaattatttcctatgcaaaatagaatcagaaaattccatctacttacaaattctttatgtacttccacattttaagctttccaagttgggaaactcaacttcaaaccagctgttgacccatcctttgttctatatcaagctttgcattaatgcagaaactgaaataagtatctccactccccaaagtgatacatctgaagtcatctggctgactgtgtgtccagaggcaccacgtcagtgtctctttgccagagcctttatgggggtggtacgaggggaactggagtctgggggcacgtcaggccttcatcaatcagaaggcagtggcagcgacagcaagacaggcgggtcaggcccccagatgagatttgtgaggctgcggcatcgattctgaccacacattctggaaaaattatcatcctacaccaccttctgaagcagtcaaggtttgggttattacctggaccagcacccggcttttacataggaccttctcctgggggacggtggtatcgttgtaaaccaaaaggttattgatcaaatcttgctaatccaagttcctgacaattaattttttaaaaaagaaattatttgtccttttaaagaacttttctcttttcctaaaattatgtgaagcttttcatttttaaaattcttttttgtttttttgagacggagtctcgctcttttgcccaggctggagtgcagtggcgcgatctcggctcaatgcaagctccgtctcccaggttcccgccattctcctgcctcagcctcctgagtatctggggctacaggtgcccgccaccgcgcccggctaattttttgtatttttagtagagttgggggggggttcaccgtgttagccaggatggtctcgatctcctgacctcgtgatccacccaccttggcctcccaataaaattatttcattacagaagcatggttaacgcgtgcgctagcagaaaagtcccaccattaaatggaggccacagtgcatggctggagaacagcaggatgttggtatctgttgcacatgtttcagcctgtttctacaaatctgcctttttcttctaacatatgggttaactaccatttctctttgctaattttacaataatatctttgcattttcccctaataaaaaaattaaattttagaaacatttaaaatgcagttaagctttttggtttctaaaaaactcagtcctacacaaagctcttagattcgggagtgggtacctgtatgaatccgttctcacactgctataaataaacacctgagactgggtaatttataaagaaaagaggttttgttgtctcactgttccacaagctgtacaggaaatgtgatgctggcgtctgcttggcttccgggggggtgcctcgggaaacttaccatcatggcagaaggcagagggggagccggcacttcacatggctggcggtggtggtgggggcgatatggggggacttgccgcacacttttaagtgaccagatctcatgagaccaacaccaagagggagctctgcccccatgatccagtcacctcccaccaagccccaccgccagcattggggatgacaattcaacatgagacctgggtggagacacagatccaggcggagacacagatccaaattatgcatttttcccctaattaaaaaaaaaaatacattgtagaaacatttaaaatgcagataagctctttggtttctaaaaaactcagtcctacacaaagctgttaattttgggggtgtatacccttccagtttgtgtgtgtgtggttatgtgtttattcccccaaagtggattggatcataataggctttttttcctttttttttttttttttttgagacagagtcttgttctgtcagccacgctggggtgcagtggtgtgatctcagctcactgcagcctcttcctcccaggttcaagcaatactcctgacctcaggtgatccacctgcctcggcctcccaaagagctggggattccaggcttgagccactgtgcccggccaggccttttccacttaaacatgtaatatgtccactaaaattttccatgtcttagaatattttcatgtacttaacagcatttaaaagaaaataagtataaatagataaaatttcgacactctcagtgtggaaactagaaacaatctcagttcagaaactagaaacaatctctgtgtccagaagtaggggactgggggcccctccaaggagaggctgggcagccattcaagtgctgctttctatgtagtagcttggaaagctggccattgaaatcgccaggcgtcattgttctaagaaccagcagggaggcagcactgtgtggtcccgcccctctgcccagccaggcatatccctgccaccccagtgccttttcacctgctgtgcctgggaacccctccccacccttgtgtccaccaaataccaccttcaccgtgaggcctttctgaccccagtttaaacgtgcccatgtccttcttccccaccttacttctgcgtgccaccagtcaccttctgacagcctttgtcatctactccttcctttccttttttaaaaattatatatagatattttacttaactggttgaaatgtgattccttttttctggtttttattttgatttcagtagttttttggggaacaagtggtttttggttacatggatcagttctttagcgctgatttctgaggttttggtgcacccatcacccgagcagtgtacactgtacccaacgtgtagtcttttatccctcgccaccgcccaccctttcacctgagtcccaaagtccattgtatcactcttacgcctttgcatcctcatagcttagctcccacttatgagtcagagcataccatgtttggttttccattcctgagttacttcacttagaataatggtctccaaatctgcccaggttgctgtaaatgccattattttgttcctttttatggctgactagtattccataattatatatacatatataacattttcttcgtccactcgttgattgatgggcatttgggctggttccgtatttttgcaattgcaaattatgctgctataaacatgcatgtgcaagtgtctttttgtataatgacttattttcctctgggtagatacccagtagtgggactgctggatcaatgttctgatctgtcatctccccccgaccagaatttaagcttcctaaagggagggactgtcttgtttgcctctattctcaaagcctagaacagtgtctccatcagtaggggcacagtcagcctctgttgagtgaattttccaggtatcaggtggtagaatgagcagttgaacgttactgtttgccagtgtctaagccctggattaaatgctttataggtactatttgttaagtctacgctgaagttctctgaggtggtactattatcctcatttttaaatgattaaactgagtcctaaataatttgaataacttgtgcaagagtgtgcaggtgatgaggatccagcgtgcaatgtacggatcaaagcctgagcgttgggctaggccggctaggccaggctccctgtgtgcccacctgaatgcaggtgtccgcatgaaggccgtgtgaatgaagagggcaggggactcatgggaaggtttacctgttttacctgttccatttcagcttttagtaatgaggacatactcatctaaaagtgtgccaggttttctggggttttttttgtttgtttgtttgttttgtcttagagacagggtctcactgtgtcatccaggctggagtgcagtggcacgatctcagctcactgcagactctgcctcctgggctcaagggatcctcccacctcagcctccggagaacctgggaccacaggcatgcgccaccatgcccagctaattttttgtatgtttggtagaaatgggggtttcaccatcgtgccctggctggtcttgaactcctgagcttctgtgttccccccacctccatctcccaaagtctcctggcattatagacgtgagccactgcgcctggcctaaaaatgttttaaataaagttattttaaaatacgaatttcataacgagaacacaaattgagaggtgaacatttgagaatttccatggccgctttggcagtagggatgtttagtttgaaactttaatttaaaaagtgagtgcagtgagtctgtctttgtagcgctagagatgggtcctcagctggccatgatagagaaggatgggcagaggcgggtgtttgagacttggaggggacagtgggggcacagcagccaggcagaggcatgtgtcagggcagagtgagaatgctaggatcctggcccccatcctcccacttgccacacagtcaagaaaatgacaggtgtacgggaagacccaattcaatacagagcagccaggtatcaaatcacagtgctgctctgcagagcctatcccgtgtccagtaaagcagacagcattccagtgttatctggaattatttacaaacgcagtgtccacaatacgatgaatcacaacttacagtttagttagattaagcgaattataatttttaatagtcagtgaatattttcacctgcctagatggggagcaaggctctgaatcctctcttgccccagccccttctccctgggtgaggcaagcatggcatgagcagattggtttttgtaaagtgcctgatgtgcagtcaaatacaggaaggccccttctttcatacatgcacgttgagttccctaaacccaaaatccaaaatccgaagggctccattgagcattgccttttagcgtcatgtcggcactcaaaaattttcagatttcagaacatttcggatttttggattagggatactcaacctgtaatttccatgataattttttttctggaaacacctatgaagttgaattggtaagaagtgctgccataccacttcaaaagagggcggtggccagggggtgctcttcccaaggagctgaaaaataccatgaaattcctgattatgccacctctccgcctgttcttctgcaccgtgtctccggatcatcatcttagtctctttcttcacaactgaacagatctgcttaaatccctcgaacacccaaggctgtgtagatttgccgctttgggcatgcctagcgaattccatttttgtgctcttttgtgcctcttttgcatagtaagcttatgagcgccatgctctttttgctaatatcagttaaaatctttccattttccacttatcctcgtaaaacaaaagcaaaacatgagttggtccagctgcataaacagccttggggctgagctaccccagccacgccgcacccccgagcacgtggaccctgtgctcgtctctgatcaccacagtaccaaaggccagagtcacagctcatgcagaatggaaagttctgccaggaaaaatagactccctcgcctaggcaaaagtatcatggatctagaactagaaaactaactggaatttcgtggaagaaactgcacctgtttcttccttttctgtagccagcgctgggaagtctgggaagacaccaaaaatagcaatgaagcagctccctggagggttgctgggagatgcttgggcacagagagtgaggtgtttgctgggaaaagccatttgggatgggtgaaggtccatgctggagttggagagcgcagaaaatggggtgagtgtaaaagtctagcctgggttacggccccagtgatcctggacaaatttggagtaagaaactcccgccagtctcatggccagagtgcccagggaaagtcttctctcccagtggtgactccgggtttccctagcccagcacaaggacttgggctggtgagctacagaattgcaaagaagagcaggagccagccagccagacctggccatggctgtgccataggatatcacagggtgtgtgggcaggagcaaatgccgggagtatatgcaagagaaaattatggctggtgggaacctgcaggagttgcaggaggagcaaagggatgtactcctgaggtttgggggctggcagcgctgggaagggagggagggaccctgattctggatgagaggtgggtggatagtcactgacgattttaacctcaccccaggggatgaaggctgctgtagggaagaatgaccagagctttctctgctgaatagccagccagccaggattctgcttcctgccgcatccacccctgacccttccagcagccacaggaggtcagggttttgcttaaagaaagagaggaaaatgtcaattattacattttggagcacaatcttacctttcagtttattttaaagcaattttccctaaagatcaaccacagtatgtgactgaactgtattaacgaaattttagcttgataaaggaaatgctttaaactcacagcaaatgtaactcgggatctccaagcacttttttttttttttttttttttttttttttttggctggacagcccaaattccaagacactagtaaaaataatatgataaaa

SEQ ID NO: 1157 - DNA, 2645 bp, Homo sapiens
gctgaagattggtgccactgatagatggcaagtgacagcaggcagaggagagcgtgattttatgtgattctttgaattttctcatgtcatttgcagcaaaatataaaatcctgactaccaaatttaaaactacaaaggaaaacaggcagggcgcggtggctcacgcctgtaattccagtattttgggaggctgaggtgggcagatcacttgagatcaggagtttgaaactagcctggtcaatgcggtgaaaccccatctctactaaaaatacaaaaattagccagatgtggtggtgcacacctgtaatcccagctacttgggaggctgaggcaggagaattgcttgaacctgggaagtgaagcagaggttgcagtgagctgagatcgtgccattgcactccagcctgagtgtcgcagtgagattccgtctcaaataaaaaacaacaacaacaacgacaaaaacagtccacgttaagacagaattcttgtcagttgtggaaagagaaatgctctccttcacctatttctctgttgaggcagcctgagcatgcgactgtcctgtgacacaccttcatttcggatgctgtgcccggccccgggctccccacttttccacggtggaatccacatgtgcattttgtagtcatggcttttactcacaattttccctctagatgcaaacgcgtctccatgaggaagagcaaggctcctgcaggatggagatcagatggatcagggatcccacagacagaaccttttgcctgatatgagcacccttgggagagacctcttcacacaaatgttccttgcaaggaaaacactcctgcctcactttcttcaacccagccatgacctttcttggtgagaaactgtaggaagagttggatctctggtgtgtgtgtgtgtgtgtgtgtgtgtgtgtgtgtgtgtgtgtgcatggtctgatatgaactacgtagcctcttccttccgggatcagctcctcactgtgtccccagatgaggctttaacccctgagtgccctggatgatggtgctgctgccccctggccctgctcacctggccccttccctggctctctctctgcagggacagggtcacaccagggttacagcatctgcctcccagcctcccagctggccagcccttctgcagtggctcagccgcagacccctcctgcacaccacagccaaaaacgattctgccaggactacagcatcccgtgaaactgacgcttaatgatgcagaactccacgtttcctgtcgtcaacttgtcatcattttccttcccagaacccccagcacctctgacaccgacctggatctctactccagaaactcaaaacccatttttgccacaccgtcacgctagctctcctttgctcccctaatccaggtccccgtttctctgcacctgtgcccaccaccgggaatctctcctgttaagtcgcctcctccatcccgccttctcctgaccccgttggcccatgcgtctttgaacttttgcagaatttgcatctgtaacaaattacttgctatttaattatgttctgtcatattattcctgttgaatttggctgagaaccatgcgctccttgaaagcagaaactgtctttgttgttctgtgtcctgattcaacccactagccccagagcacgtctgcaggaaaggccttctaagctcaggtcatcaagctcctcccaactgcactcttttacttctgtttttccaagtcgatctttttttaaaaaaaaacaaaaaacttaaatgaattcattattaaaaaaactttttatcacctccagaaatggaaaactgtatcatttgccatcagtagaatttggctgtaaaagcaaattccatgtaaacagaacaatgctgttgggtcctacttcctcagtctgagacctgctctttctcccgtggtcatggagactccaagttctaaagacatactaggaacagagagcagcttttattgtatccagaagaagagagacagaaaaaaacagaaccacctgaaaagtgaacaacttcctcactctgtgattggcagttgttgaatccagtgaacaggcaccaccaaagatcaccctcagcccacacctcaggaccctctggtacagactccaaaatctaccacttactgtgtgagttccaagtaacaaactctgagtattatcttatttaactcactctggggtgagttctctaaggaagaacccattattatcccgctttccagatgaggaaactgaacatagcaggagaaagaagcttgaccacaaccacacagtagtaagtgactaagtcaggacccagtgaggataaacagtcatcctaagttttataagacagaaaatttaattacagggacttcctagatggtagaagagccaaaacgtcagacaagggacattgaggcaaccctggtgtccacagcatcaggaagtggctaccacctctcagatgcacaaggaaggaggcagttatcagagcccaggaatcagactcactgaagggaagctagaaccagggtgggtctctgtggcaggagctggcttgtagaaggaaagagcctccaggcaagacagcccaacaaacagagtcaagaagcccacccagactcctgtacacacccatgt

SEQ ID NO: 1158 - DNA, 4499 bp, Homo sapiens
cctccagggtcttccaacgccaccttctcttccagcttgtggctgaggaggggccccttggctctcccatgcatttggcccaggcatagccacagctgaggccccaggcctgctgccctcccctccacccctccacctaggccatccttggcccttgatttcctgggcccaagttcggtcttggcccagtggtggcagagtggccctgggcagtgggcccacatcatggtgggtgtggtcctgctccctgtaggtgaggtgctggactcaggcaggaggcccagatggagaggaaccacactcaatctccagggggcagccccagaggtagccctgtgaccttccatcctgcccctgtgtgcctgaaccaagccctgaagcccctccccctacactgacggctgggctgcccaggtagctggggcagtggggcctcagtttacccatctgtaaatgaaatgtgggcatgctccagcagcccccagagctatgcccccactgggccaccatactcacactgtcctcaaggcctgatgggattggcacatcagtgcaacccagcatgcccctgcccctcccctcctctgccagccgtgggcacttggcacagggcaggaggccacctgtcgggttcattgtgtggaagggcctgggcctcaccagacccaaccccagcccctgctgtggggccccagggagccctctcttccccactaaggtcggctttgtgcccaagatgccccagcccctgcctggcgggttcaggagcagccagaccaggtgggctattgctcctccccagctgcaggcccggctggagaccaccgaggctcagctgcggaggtcagagctggagcacagcgtggatctggaggaggcccttggccgtctggaggctgccgaggagaggtgaggccaggtgcggggcagtcagggctgcaggaagcacagccatccccccgagaggcagtgggaccctctgtgccttggggctactgacagctcttcccaaagcagctgtgagttcagtttccctgtgggagccaacccaggcctccatggcctggcagggcagggcagggggctggagaaggcacggctgggaagggggactgacttgagtggctgggcagtgtgggggcctgcagcgcgctccctcttgctgtggggagaccccaggccgagtggaaacagtgaaacactcagcctcctgggctcagcgtgggcctctcacgcaaccaggcaccaccgtcccagcctctgagagcggctcagcagcatccctattatagtagctgcatcacgattgtacccatcgctatcagacccctcccccgctccacaggccaggagcaggggctgctcaccatgggggacgggactggtgccagccttccacgtggcagcctctccacgctctgccatcctccctgccacgggtcaacctggctcatgaataacagggagggagtggcaaagagagacagagcctcatgaatgacagggagagagtggcggagagggacagagccccccccgccaccgctgtcagtgagcactgacattaggaccctggcaacagaccctggccaccagccacacctgagtccagtgtgtggatcacccactcacaccctgagatggagctgacgatgtcatgcctgggcttatcaagggggcctctgcccggcccccaccctgcctgtactaacccggccccccacactaacccagccccccacactaacccagcccccacactaacccagcccccaacactaacccagccccccacactaacccggcccccacactaacccggccccccacactaacccagtccccacactaacccagcccccacactaacccggcccccacactaacccagcccccacactaacccagtccccacactaacccagtccccacactgacccagcccccacactaacccggccccccacactaacccagccccccacactaacccggccccccacactaacccagtccccacactgacccagcccccacactaacccggcccccacactaacccagcccccacactaacccggccccccacactaacccggccccccacactaacccggccccccacactaacccagtccccacactaacccagtccccacactaacccggcccccacactaacccagcccccacactaacccagtccccacactaacccagtccccacactgacccagcccccacactaacccggccccccacactaacccagccccccacactaacccggccccccacactaacccagtccccacactgacccagcccccacactaacccggccccccacactaacccagccccccacactaacccggccccccacactaacccagtccccacactgacccagcccccacactaacccggccccccacactaacccagccccccacactaacccggccccccacactaacccggcccccacactgacccggcccccacactaacccggccccccacactaacccagcccccacactaacccagtccccacactaacccagccccccacactaacccggcccccacactaacccagcccccaacactaacccagcccccacactaacccggtccccacactgacccagtccccacactaacccggcccccacactaacccagcccccacactaacccggcccccacactaacccagcccccaacactaacccggccccccacactaacccagtccccacactatcccggcccccacactaacccggcccccacactaacccagcccccaacactaacccagccccccacactaacccggccccccacactaacccggccccccacactaacccagtccccacactatcccggccccccacactaccccggccccccacactaacccagcccccacactgacccggccccccacactgacccggcccccacactgacccagcccccacactaacccagcccccacactaacccggcccccacactgacccggcccccacactaacccagcccccacactaatccggcccccacactaacccggcccccacactgacccggcccccacactaacccagcccccacactgacccggcccccacactgacccggcccccacactgacccggcccccacactgacccggccccccacactgacccagcccccacactaacccggcccctcacactgacccggcccccacactgacccggccccccacactgacccagcccccacattaacccagccctgcacagcaaccaaggcccaccagtctcccagacctggggaggttaagttgtctatagaatatcgacacatttggttcatcctccaggaatctggaaaaggaatcaaagtgctgagaaacttttgaaaaccagttttgagggggaagaaaaataacccaagaggaggcttaggcctggcgggggtgccggctcccgaggtccacccacctggcggacttgcacccctactgcagcaagtgtggacctacttgtggtggggaagtccccagggtgcagcagaagccgtcccccaccacgggcatgtctgactccctctccgcgtcaccccgccccgcgaaaggcacctccctcccagcccctggcaccttgtctcaggcattgagggacgggccaaggttgcagagccagagccaggagagctcggggcaggggcagatatcgcagggaggcaggagggcactgggctggcacctgggagagccaccttgatgctggcactcagtttaggggtcctttgtggggcccatggcaggtgggggcagagcagcggctgtgcacctgagcccaggtcagttaggcccagagggtttggggttccattcaagccccttgacttggggactctgagcgcctctcttaggagaggcttcctacccccaccatgccctgtgggttctctgtccaggagcaccggcctctgtcaggtgaacgcgctcctgcgggagcagctggaacatatgaagaaggccaatgacgcgctgggccgggagctggccgggatgacgggcagcgtgcagcgcctgcagggcgagctggagctgaggcgctgggcccagagacaggtgctcccccaacccttgctcacctcatggcggccgcctgtctgggtgcctatggctgggtagcaggcagggacatggtgagggtgcactggctcagtggctgtccctcttggggacgaggccacagcttcttgccacaccatgtccccaacccggcttggccacagcagtctgtggagtgagggacttcgtggtccacccctactgccccccacccggagaaggagggcagggatctcagaatggggcactggggccgcaccccagctctggtgtggaccacgctctttggagaggcaggttgttctccgtaggccgaactcctggccagacttcaggagcagggaccttggaa

SEQ ID NO: 1159 - DNA, 2522 bp, Homo sapiens
gctttctcctgtctatcatctccttttataagagcttgataatctgtgaaaatttattttagtcttgatttgtctggcccaaaagaagaactatggattaggtgatgggaggaaagagggtggttatgtctattctacaagctcaggtttattcaacaacctgagcttgtagaataaaacatcaaatattcaagactcagagttactttcctcctcccatcccattttctttaggagatgtgcaatgttttggagaagactgctatgcattggcttttggagttccaggactgctcatggtaattgcacttggtaagtgcagtgaagcaaaggaaactaataatcattgatacctgacacatgtaaagcatcatgtaggcactttacacaagctgtttcattcaatcctcacaccaggcctattgggtaactgttattgtaagggtttcccctcaattttggaggtaaattctgaatgaagtcagaaactttaagaaaaaagtgcctaaggttgcataaccagtaagatgctttctggggagccttaaaaagtccaaactctgggccagtcagggacttgggcttttttttagtatctcgggtcattctaatgtatagtcaaggtggagatccactgctctacactacaatatatagggaagcaaggaagataatcctctttcaaattagtttacttcatattatacttatttatctggtaattggaaaagattttaaattctccaagccttttaaaacagcttctaggtttagctatttctgccctgctctgtagtgcccccaaagggtctgcccttgagtaaagagaataagaggagttggataaataggtgaaaattaatgcaacttaaatcaagtggcattctctttatccctgagaacccagtcctggaagagaagagggatgtggtgttccttattttacatagcctaagggaaaacttgggcatgattatttctaatcattgacctggaaacctgttctccactctgagcctcagagtgacacccccttggaagatatccagtgcaaacccataaagagctcaacagaggaaaaacagcctacagactcaatgctcagtgtattttctaccagggagttgatgggagggcactgatagtagtactcagaattcccaatgccaaggaaatttattataggtgagctgtgataatatattctttacttccttctgcattcaaagccaaatattttcccaaatatttgcatgataataatatttacataacagagtaattatgaagataaaacagagatgctataaatgaaatgtttcataaattatgaaatgttaaacaagtgctagctgtcattattagtcagcagcttcagttttctgggtgctaatcaataactcaattctctgatcttttactgtaattaatttcttttttctttttttttcttttttgagatggagtctcgctctgtcgcccaggctggagtgcagtggcatgatctcggctcactgcaagctccacgtcccgggttcacgccattctcctgcctcagcctcccgagtagctgggactacaggcgcccaccaccatgcctggctaattttttgtatttttagtagagacagggtttcaccgtgttagccaggatggtctcgatctcctgaccttgtgatctgcctgcctcagcctcccaaagtgctaggattacaggtgtgagccaccacgcccagccaattaatttattttttcattcactcatttttttaaccaacatttaatgaacctattgtgtgccatattatgtgctaggtattgggatcacattggtgaattagatacctagagcattcatgttcccaaagaacttatatagttcagtagggaaaggaagacaaacaaataaaaggaatttacaatatggtatgatcagtatttcccagatcaatatagtgtgatctaggaaagtacagagagagctatgggaatgcatagaagcaatgtttaattaagaccttgagggaccgggcatagtggctcacacctgtaatcccagcactttgggaggccgaggcaggaggattgcgtgagctcaggagtttgagaccatcctggacaacacagcatgactccatctatacaaacatttaaaaattagccgagtatgatggcgcacacctatgatcccaactatttgggaggctgagatgggaggatcgcttgagcccagaaggtcaaggctgcgatgagccatgattgagccactgcacttcagcctgggcaacagagcaagcccctgtctcaaaaataaataaatgaataaaataataaataaataaataatactttggggattgtaaaaagtttgcctaaaggaatgacatttaaggtgagacctaagggccaaacagcaattaatcaataaagaaattataagtgatgcagaaagaggacacagtagctgtaagacaagaggctgagaaatagcatgacatgtttaaaggttttaaaggcattca

SEQ ID NO: 1160 - DNA, 2432 bp, Homo sapiens
gtgcacatgtgaagaccattgaaagcatttgtaagttttgaaaagtactgttgtattgttaacactcatttcttttttccagatcatgatgctgcgattaatagatatagccgtttatcaaaaaaaagagaaaatgacaaggtgtggtacatatttattccttcagtgtcataattaactattcattaggtggtttagtttttcctctatcaaaatagagccagcagttactttgtatgttttgttatattactattagtttattctttccttctagctgttcaaaacctttctgataatcattgacctctttaaacaaaatattttcttctgccaaaatttgatgttataagtaaatataactattctggaaatttaactgatgcccagtatataacattgccttttgttgctttgtattttgatgacatggcattggttctgtttgaatatataggtgtgttcaaaaatgtcttctgagatagagtggtcacacacataatgaaattctgttatgaggccctccttatttatagacatatatatcttttgatatttgttcaaggagtgaaatacagaaatattacactatatttgaggagaaatgcattcaagtaaagatgagagtacagagtattaacaggtttttttgggcgtgccttaagatcatgtctttctccagcatctagtccaaggcttgatgtgtaggtctttctagatgcttgtgactgaggtgatctctgtgcctgggtgttggtgtctgcagccttggctgcagctgctggtggaaacacagtgactgcttgtgggaatccacagttgggtaggatttactgtgcaacagctactgtgacaaaggaaatgtttctcacacaaagtttagtacaaagattgatttccttttcgtttctaattttagctgcagactactacttaatggtgtattgataaaatgtatacatttgagatctctattagtcacttggccttagagaagtagttaaaggctctgggtataaaatttgatatattttacattacttctggctgctcaaagtattttaaaaaacactctgtcaccaacttcattttatttaaaaattcattgagcacctaatatacgtcaagcagtctgttgggtaccttgggggaacaacatgaataggcttcactcctgccctcaaagactggatactccacatttattgaaggctacctgtgtgaaggcatgcaggtggactaggaaccagagtacaaggatgacaagaaggcatgaattaactctgttattagttaaatacaataataggggttttaataaaatgctgagagagcacagagagggcagcagttcactttgattggtgaattgggaaaggttacactttttttttttttttgagacagggcctcattctgtctcccaggcaggagtgcagtggctccgtctcggctcactgcaacctccgcctcctgggttcaagtgatcctcctgtttcagcctccccagtaactgggattacaggtgttagccactatgctcagctaatttttgtatttttagtagaggtggggtttcaccatgttggccaggctggtctcgaactcctgacttcaggtgatctgcctgcctcggcctcccaaagtgctgggattacaggcttgagccaccacacatggccagcaaaggttacacttttagaaggtgacatttacattaaagataagtggataacaccagtttggaatcggagagagtgctttcctgaaagaaaaacagcctttcagaggcacatggtggagttgggagagtgtaaagattaagagtactctgtgacaataaaggaaatgttaggagatatggcagaaagagtaagaagtatattagtaccagattactatattaatgaccttgaaatttgtgttagagggagtggacagccgccaaaggattctaagtaggtgaataacatcatgcaattgtgttatagaacaaacatactaatgaaaatgtgaagaggacaagactagaggatatccagtgaaaggaattggaatagtttgcagagatacaatgaaggcctcagctaaggttgttactgaaaatggagaggaaggagtacttttgggagatatttttttaagtagaattgacaagacttgtggtaataggaggaataaaaaatgagtcctagatttcttggatgtctggatggatcctgtagtaattaagaaaggtaagaaacaaagcagaagaacaggttttgtgtacaaaactatcttcagttttgtacatttttagcacataaacacacataaagaacccagctggagatgtgtttactctgtcacttgggaaggtgagagggaggagataaaatttgtgagtcattgagtcattggtgtattggaatattagaatattcttcgta

SEQ ID NO: 1161 - DNA, 2377 bp, Homo sapiens
aagatggacattgttagttctgtttcatagaagaggaagtaaaaactgagaaagttaagtaagttgtctttagtggtacagctagaacccacagctctggaatgtgaactcccatccctctgattccaaaattctttgtagaattcttccaccttcataccctctcatcagactgagtcatagatctggaccgggtcttcaggaagactgtagcttctccatctgtaagagccttcaaaaaagtatatgcagcatttgcaacccagcgcatttacatcttcacctgtgtttttataatgcttgctcaaaagttctatgaagtgaggctctgcccatcctagacccctgtttcagatatttgaaaggactctgttaagtatagcactagtgccaagtggttcaaccactctgaattcctacaacgtattaccgatttttcccttaggttatttatttattcatgtatttactcggccacttaagaaatatttctagtatccactacacgccatcctgtgtactagacccaggaggttcagtcgtaagacagacaccatcccttccctcagagatgctaccattccatgtgataagacaactaagaagcaaacaaataaaatttcctgattgaatttagtgggaagaaataaagtggctgcaggaaaacagggagacagggagaaccaccgtaaacagtgagttgggagagatctatcaggaaaagctacctctacactgagatcctgaaggtgagaaggtgacagctatgtccagatacagggaaatgtgttcaaagcaagcagaagagcaagtgcaaaggccctgaagtgggaaggatttcaaatactctggaatatgcagaaggccagtgtgactagagttcatcgaagggtagaaagattagaacaaaacagtaagcaagagaggctttttaaaaagctagatccattaggcttcataataaggctccagcaagaaattttttcagaatgcaatggcagagccaaggatatagctttaagccaggagagtgatataatcggatttaaattttaaaagatcatctggccactgactgaagaatggatttgagggacaagggtagaaataggcaggccaattaggaggctgttttgatagactaggtgagaaggagggcgtgaaagggatggaaagatgtgagcagatctgaaataaaagagaaatttaacagacatttaccttgagtgagctatctgtgtacattttttacttctctgacaagcctctaagccaagctgtgtgtcttattcatctttgtattttcctacttctcttctggtagtcatgatgaaaacagagttcttcaaaattcttcctcttccagattttgcatctgtcaacaaaaacattttcttccctgcagaaagtagatgtttgtctctaattgtggggcctgaggtttgccatccacatttgctcttctgccaaagtcacgctgagtcgtggaatattttaattttttttaagttcagtttttacatctcattaaaaatgtgttggctgacatatttcagaaataaatatgcttaataatacctcatttaatttaaggctctcatttagaaaaaaacactttcaatgaaaagacttaaattgattaatcaagggattttttcgtattccttattagcagttataagactaatggtgatctaccgtaagccttccctttgcctaatgtggttagagctaccaaagagaaatcgttacaacctgtctaatatttataatggctattccaactgactgttgagaccattttagcaagaaaagaattaaaaacactaaacaagtcacatgtctcaattatgtttatgtatatgtggacaaataccctaaataaagatgaggctgtcatctttactacaaataatgtagcaatgatttatggtttgaacaatgacagaatgacagaactaatttgcaataggtcatatgagataaatttcaccatttttggttcatttactttgatttcagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgaga

SEQ ID NO: 1162 - DNA, 3157 bp, Homo sapiens
ggccaatgatgacaagactattgggagctccaaggaggatagaatcaagtgggaccaattatggttaggggcttacttcatgccatatcaagccaccagccttcacagcagagagtattagcatttgttgactgtatatcacttgccaaacacagttctataatcccatttattctcctgacagcctcaacaagcatcatcacccatatttttcaggtgggaaaagttaagtttggagaggaaaagtcctctgtgcaaggtcaagagccagggagtgactcaatcctcagacaccagaaacaatgcatatttcaccacatcctgatttctccttttctggcttcctttccatgtaatgcacaaacgtaagaaacagaatattgggaatttttgaggtcggcaaacttaaaatcacataatttctaaatatgcatctaaacagttatcaaattaattttttatttaagcagttatcaaattaatttatgtaaacagctatctaaatatgttccttcaataattcatgtgatatgtgcagagtaggcatctaaaaatattttaaggaacaaacgaatgtactacatgttctttgatatttttttcatatgttgacaaagtttctatttttttttccaacttacaaccggtaaaaatttcactctcataatgtctttgctgctttgctttttcatctccagtgtatcattccacttcactctccctcccctcttcccagctacgacaacgaaacaccatatctcgaaaatcttccccagtagctgcagtcctcgggaacctatctcctcctacgtcatcttgcagtatcccctttttccatggcagccttcttcctgagggagaccactctgctgatcttccctgacaaaaaaaacccaacattttgtaaaactttacaattcacaaagcaatttcttccaagataaagtcatttgattttcacaataacccagagaggaaggcaaaacaagtatcattaactcctgtttcaaatgagaaaatcgagactcagaggggctatgtgatttgctcaggatcatgcagctgcaagatgaataaagactcaaagcatggttttctctctccatgccccaagctctttacactgaatgattttgcatgttctctcctgttgacttctgaggcagcttgccaagtgaccccagctcatgcactccctggttccaggtctgccaccctcagctaccaacatccacagcagtgagtaacagttgggctctcaatgggaagccatctcaacctgcctctactaagcaacaagattgtcatagagacaggtgaacaaataagcagaagccgatcatcagagaaaagcctgttgcaatagaggctgcatatgcagggactgaggatcttccccagatactcacaattccctcaaaagatcagaaaaaactctggcccttaaacactttggaatcagacataggaatgtttgagtccagctctgctgcctctataaccatggataagttttaacacccctgaactccaaaatagtgaagagaatattaacagaatatttgtgagcatcagctgagatgggcaaataaagtgcttaggataagacctcaataatggaagctatcatcaatatttgtaatttatatgatatatggttgtaataataatacaacatgataaatataagaaaattgtgtaccccaaacaaaacatggatagaacaaggaaacaaaaaagctaccaaaggaagctctgcaaataactactgcttttggtatcactacacaaatatccagtattaatcctatttcatctgtgtgtagtttttcataaataatgagatgggtgtttaacccaggatcattctttgtacatgaaaggagctgactaaaatgcacatgtagcataaagcacaggttgatatccttcaatctaactgtgatggcaaactgcatttgggaatattttggatttgttctcaacaaagtcactccagcaaattcttggtatatggaagttgctaaagcaccattcagaagtaagaatacagagtatcactcatgtggcttcaaagggtacagagctatgtgatcctagggagagataaatttggtgctccaaactatcaaagtacccagacctgaattgttctggggaagcctaagttttattgaaatcttgaccctttgaagggccctaacatttctcatctggaagccaaaattcccaaagttgaggtgttttaacattaagaagtagagtacttagaaacactacgtgagaaaaacaaattttgtgcccgcattgagtttactgtacatattttagagaaacttgactttgatagcgtgttggttaattttatgtgtcaacttgcctggactaagggatgcccagatagctgatgcaacattatttctgagtgtgtctatgagagtgttttcagaagagattattagcatttgaatcagtagacagagtagagaagatcctccctcactaacactaatatgagcacacatcatctaatctgtttagggcccaacaagaacaaaaaggcagaggtagggtgacttttctctctctctctctctgtgaggtgggacactcatcttttcctgccttctgacatcagaacttctggttcttaggccttgggacttcaggacaccattggttcttatggctctcaggccttcagacagactaaattataccactggctttcctggttctccagcttgctgagggtgggatttctcaccaccataatcatgtagccaacccttataatcacttctcttctcttctcttctcttttctctctctctatctctctccctccctccctccctgcctgcctctgtttaggtatgtgcatgtatgtgtgcagtgtgtgtgtgtgtgtatacatattctgttctggagaacactgactaatacagatagctaagaaaataactctattggaaaattagaaaatgtgctactttgaggaactaaattatccttgcaaaactgttcattatcttaattaaaataatagacataatttctatttttagaaataaggattctctagacttggacaaaaaatggaaaattcatttattcattccatatgcactacatatatatatatatatatatatat

SEQ ID NO: 1163 - DNA, 2265 bp, Homo sapiens
tcatagcaatggtgtcatacagtttgtactttttgggtccagtttctttcactccacatcatgtctgtgggaatcatccatgttgttgcatgtgtcactggcttgttctaatttttggtgagcagtattccattgtataactatgccacagtttgtttatcccttctcctgggcatttgaattgtttctagtttttggctattttgagtaacactgcagtgaacattcatgtacaagtctgtttgtggacatacacattcaaagtggatgaaacacagataaagagagtcaaaagattttcagttattcagggtgaggaaactataacagagaaatccaagggtgattggacttcaagacaggctaaatgtgtcccctctgagatgcattacctcatttgaatgtattcattacatgagttgtgtgaagaaatgaattaatcatggtgccttcagcttagtcatagattatcttgcaggaagggaggttcctaatggaccccattttcgactcactggggaagcagcgacccttgggagtaaagctacaagacatctctgtgttgaagagaggactgtaggcttcccattgtgtaagagaaattctgaattttcctattggtcctgattccagcttctgggcaatagtttaggcagaggaggcaatgatgtgccctgctctcagccactgaagtttcaagtcagaagacctctagtgctcaaggctctcatctccccggctatgtgtatgtagcaacatggaaggccagcgccttgtgatagacagtttaatcttacctgcctgctgtgaggtacactcaccatcccagagaattgcaaagtataaattgtctcttaacactgataaacagtaaggaggaggaaaaagccctgacaaaatattacagcttaattgtatttctcagctgggctcaggaaacctgcttcctccttaggcgaatgctatttacgaagtctcccagccccacaataattatttctttaacccctggtgggatagcaccttagcatggaatgggactgcactgccagggaagcttaatgaggctgtctcaggttcttatgtgggtgaggtttgccttcattaggtgcatgcatcactgtgacttctggcttcgggcctcaggggtggcaggaggacaggctgcccctgaagatagaggctgttggggaagggggtggggaggaggaggcaagactttctgctggcctggttttctagtacacaggtgtttgcaattctaaataaatgtgcagtgtcaggactcagcagcccatcagctgagacttataatgagggctgagcagggaaataagattggccttctttgggcacttgtcattatgttgggtagacccaaattcaggcctaattatgtgtgtgtgtatatatatatacacaatagtctggaagaactgggtttgggggtgcaagagacaaggggggtggccacctgtcagaaatattgtgtgctctgaaaatctccctgtgtggaatctggaagctcattgctgtgagcattgtttgtttgtttgtttttttttttttttttaaactttgagcgatatctttatgccttctgcaaagttttgaaaaacactatttgaatagccagtcagaaagaggggccagaggcaaaagccttttcccttcacagagcagtgtccactggtgacttacaaaggcccatctggtgccctcggcaagtgatggctgcttatttcacctagttgatcatttactcctgcatttgtctgtttgctcatttattcattcattgctatcaacacttagaataaaaccccaactcctcatgttactgagttgaatagtgtccctccaaaattcatgttcttccctgaagctcagaatgtgaactatttggaaatagagtcattgcagatataattagtacagttcagatgaggtcatactggagtagggtgggcccttaacccaatatgactggcgtccttataagaagaaaagagacacagagtgacacacaaacagtagaaagaccgccatgtgacaccagagccagagattggagtgatattaggttgctgtgaaagtaattgtgttttttgccattaaaagtggcaaaaaccggctgggcacggaggctcatgcctgtaattccagcactgtgggaggatgaggtgggtggatcacgaggtgggtggatcacgaggtcaggaggttaagactagcctggccaaaatggcaaaaccctgtctctac

SEQ ID NO: 1164 - DNA, 13871 bp, Homo sapiens
gaatctatctatctatcatctatctatcatctatcatctatctatctgcctgtttatcatctacctatcatctatctatctatctatcaatcatctgtctctactatattttcttccttgtgtatgtgtgtgtatacacacactattatatgtatacattttgccctctacatctgtgagttctgcatccatgtattcaaccaacctcagttcaaaaatattggaaaaaaaaatcacatctgtactgaacatgaacagatatttttcttgttattattccctaggctatacagtttagcaactatttacataacatttacattgtattaggtattataagtgtgtaggttatatgcaaatactaagccattttatatgggagacttgagcatctgtggattttggtatccaaaggaagttctggaacaaatcccccatggatcctgagggatgactatatatgtatatgtatgtgtatgtttacgtacgtacactggtgacctttaaatgttttgaaagcacctaaaacatagtatattaaatatctttcagtttgaaatactgaagtagtttctatttcttgtgttgtactctggcttttaggcatagcttggagattcctttctatggaggaatggagaatcaagataattagctaatctccatctctgtgagctgggtttgagaattctgcttcttcctcaaaacttgcttcaggaattcccaggactatttactttacacattcccaacttatgcatgcatctattttggtagggtgcaattcaaggaccactgggcagggaatcagagcacctaagatagagcacttatctctctctaactggctgcatggcttggggcaagctgggcaacttccgtgagctttaacttcatcatctgtaaaggattggaaccctcccctcttgtatcagaggattgctataagaaaccaacatcaataacaagaactgtcaagtgaccaaatatttacagataattgtcaatattccaggctccatgtgaagcactgggaacacagctgaaagtgaacagtggtgtgctggtaaaccagctttccataaaagaaaagccctcatttgtagcattggccaatgtctgtggtgtaagtactcctaccatggctgatttcaagccactgacctcactgaatgcagaattaggaataaatgcatccaatgagctctctttctctctttttttttttttgaaatggggtttctctctgtcgcccaggctggcgtgcagtggcgcgatctcggctcactgcaagctccgcctcccggattcatgccattctcctgcctcagcctcccgagtagctgggactacaggcgcctgccacccttgtgaacttgctccaggacacaactgacacacagccttgcttggtgtaaagattacggcacagagacggagagccagccatcaaacacttagtctgattgcaagctgaagtaagtgctataaaggcaaagaataggacatgatgagaaaataatacgggtgaagttaatttaggtgactggcctggggaaatgtgacattgaagctgagacccaaaggatgaagatgagttactcaagtaaggagagggaggaggaggaagcaggaagaacatcccaggtgtaggaaacagcatgtgtgagagccttgtgaccagaatgagtttggcgatttgaaggaaggcagtgagctcagagggattgcgggtagatgagattgcacagggaaacagagtccagatcatgtagagccctgcaggcagtgaagcgtgttgggtttaacccaaagcacactgggaagtctttgaaagttggaagcctggatgtgacatggatgatcggggcaaacatgcaagtaggaatgctatttaggaggtatctgcaaaaatccaggagagagaggctgcctgtaatggacatggagaaaagtggactgattcaagatacaatttggaggtagaattattatttactgaacctactgttatttatgttttgaaccttaagttttttttaaattttatttatttatttatttatttatttatttatttattttttactgagacagagtcttgctctgtcgcccaggctggagtgcagtagcatgatctcagctcactgcaacctctgcctcctgggttctagcgattctcctgcctcagcctcccaagtagctgggactacaggcacacgccatcatgcccggctaattttttgtatttttagtaaagacagggtttcgccatgttagacaggatggtcttgatctcctgccctcgtgatccgctaaaattgatcatttggtgtacaattctaaacattttagcacatggagagccaggtaatcatcaccacaacaggattcagaacagccccatcgcctcccaaaaacctcctagtgctatttttttttttgtagtcacattctctccctcaacagatctagaagcctaacagatctagaagaagtagggtcatgacctgatcccggtcagaaccactatttatctaggtcccaaatgtgttactgacagtcctgtatttaggagcatctaacagactcagcctttcccagggggttatttccaccccttgacccttcatagacttcttactctaccagtatgttcagtccccatcttaataggcacagaagatgcaggaaaagcctgtaggagttataaaagctcaccaaaatttccacatcctgagatatatctacaaagtcagtaatgggggaaggcaatctatttttaggcacataaataatttaggtcagaatatttcaggtagcattgcattatagctgaaaacaaacctcagtttgaatggttataaagtgatttcaataaacatcatttctaaaagcataagcattttaattagctcatctgtaactccacagggcctgctgagatataaatatacatatatattcataatatagattgttgtgaatagatttcttattagttgcatctctctctttcttcctctcccattattgtttttttatttcacaaaatgtcctctatctttgagtgaaagaagagttctgtttacttgtgttctggggtcatagaaaatggataaaattattttctctggaaaacaggagggttcaggatagttcaaatatctcaatttccccaaagaacttcatgtatcacttcatctagagttccctggttccagggaggaacatatgagttaactgaggtcttgtcattggtccgggcactagaatacaagagagtaccctacagatgagcagctaaaaggggagcaggggaaaaagagagagactttcttcccagcaattctaggctctattctgggtaaataaaggttttgtgtcctttttcttgctgggtcctctcaggagcacagtgagacacactctgatttccacactgcagatggcccacagcataacttttccaaggctgtatagttatgccttgaatccagaattcatgtctgtgaaagaagacaggctatatcaggggtcagccatgccttttggttccagtgatgttcgaaggtgcactaggaagatgagagatcttttaagaaagtggagaaacagaaggaaacacaaggcaataagttaatattaaaggtggaaatagagggaaaacaaaaacagcccttgacatccgtgttaggctgttctctcactgctataaagaaatatctgggactgggtaatttataaagaaaagtgtaagatctgcaggccatacaagcatggcgccagcatccgctgggcttctggaaggcgtcaggaagcttttattcatggcggaaggtgaagcagggacaggcacgtcacatggtgaaagcaggagcaagggggagtggggagatgctaaacacttgtaaacaaccagatcttgtgacaattcactatcacaagaacagcaccaagccatgaaggatctgctcccaagacccaaacacctcccactaggccccacctccagtattggggattacaattcaacgtgagatttgggcagggacaaatatccaaactatatcaccatctataccagcgagaacttctgtaagacactttggagtttgcagagttcttttatgtctactgacttatgatttcagaggcattggtggaaaggactcagattttgtaaatagacatactggttctaagccccttttgaaccacagctgagaaagttgtgtggcctgagaaatagccctaccccagatttggaattgaactttgctttggttatctgttgctgtgtaacccactaccctaaaacttagtgggtaacaacaaccacaattttaccacaatttattttctctcgtgactctgtgggctgactacacaggtctcttgcttcatgtggtgtcagctagactcttgagatggcgagtaggtgcaaaatgccctgactcatatggctgagaaatggtgcttcctgctgattgagagctcagctgggttgttggctgagggcctttgtgttcatccatgtgggcctttccatatggctgcttgggcttcctccaagcatggtagctgggttccaaggaggagtgttccaagtgaacaagccttaacgtgcaagtatatatcaagcctccatttgcatcatgtctgctaatgtctcattggacaaagatagtcacatggccaagttcagagacaatatggtaggggactaaacaaagacatgaatactgggaggttggttcactgaggccatcaaaggaactgtaacaatctactaccatctcgaagaaaccattttgcaacctcagcacacaaaacattgtttgtggctcagcctccatctgaaacttcatgtccaccataaactttcttgccaaattctaatagaatgttccttctgatactgagtcacaactggactgccagttttatgcactggtctttgttcacttcttgtgggacacagtaccagatattacaagcaacttagaagaaatatgagctcttattcttgccttaagaaaacagttgtccaagtgctgagatgggaacaagaaagagcacattggtaagggaggggcagaaattcagagaagaaaaagataaatgaaggacagaatgggaagagaggaatgctttcttcccttttaccatctcttctttccttccttccctgtttttgtccttcttcctttctattctcgtattctatacccaaccttttctgaccctcttctcatcttaggtgtgagatcatcctaagtaatagtgaatcaggctcatctattgtattaattatctattgctgtgtaacaagttatcctaaagttttgtggctcagaacaacaataaatatttattatcttctatatattttatgggtcaggaattgaagagtgtccaagttgggtagttctggatcaaggtactcatagcatagctgtcaagatgtcatctggggtggaagtcatgagaagatttgaatgggtcaggagggcctgcttccaaggtggctcactcacatggctgacaggctggtgctggctgttggtgagtggtcacatcctccccatttgagcttctgcacaggctgctgattgtcctatgacatggcagttggtttgtcccagagcaaggaagccaagagaggagagtcaggtagaagctatcctttttatgacctacctttagaagtcacatagcatcacttctgccttgttctgttcattagaagggaaaccccaagtgtagtctgctttcaatcagaggagaattagccttcaccttctcaagggagtagtatcaaagtatttgcagacatttaaaaattaccatattcatgttttcaaaaggatcctcttgaagtcactgagtatattctgtcccacttcagtaatttctgaggtgggaataggtgggtgataaggaactcttaccatgcagtggacaaatgatttttcagcaaccaagttcttgttcacctttgcaagaaagttcccttctcacacatgctacagctaatgctgacccagtgaggctgaatgatggctctcaaatgccagaaagctttcgaaaggacaaagaagactggaatggagaaggtgcacgagtgactgctgtcagtcaggcaaatcataaaggccagtgctccccttgtccagttagagaaccaggcccttttgaagatgaaccttctgtgactgtccctttgcttccctgaaatgaagtgtatttagaccatgtgcttattttttacctcccctcgtgtgctctgatttattaacgtgtgttatacactgagtcagtttaattaattgtagctcatatgctaatatcactctcctttcccactactttccttgaaggaatctgcaaagattagatttgacctgctgctgtgaaaaatacccaaaaggaggatggtgaaaactggagtaagggatcctcaacttttggaaagaattatctgggatattaaaggaatagataggttatgctttttttggttgttgtcgtccctttctctgttcaggttttctactgggacttttttggagttggtcttgctcaggctgggttctgcctggccagctcagttgtaagtaggagagtcttttttttttttttttttttaattattatactttaagttctagggtacatgtacacaacgtgcaggtttgttacatatgtatacatgtgccatgttggtgtgctgcacccattaactcaccatttaccttaggtatatctcctaatgctatcccttccccgtcccccaatcctacgacaggccctggtgtgtgatgttccccaccctgtgtccaagtgttctcattgttccattcccacctatgagtgagaacatgcggtgtttggttttctgtccttgtgacagtttgctgagaatgatggtttccagcttcatccatgtccctacaaaggacatgaactcatcattttttatggctgcatagtattccatggcatgtattgctacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttgcagttctagatccttgaggaatcgccacactgtcttccacaatggttgaactagtttacagtcccaccaacagtgtaaaagtgttcctatttctccacatcctctccagcacctgttgtttcctgaccttttaatgatcgctattctaactggtgtaagatggtatgtcattgtagttttgatttgcatttctctgatggccagtgatgttgagcattttttcatgtgtctgttggctgcataaatgtcttcttttgagaagtgtctgttcatatcctttgcccactttttgatggggttgtttgatttttttcttgtaaatttgtttaagttatttgtagattctggatattagccctttgtcagatgggcacattgtaaaaattttctcccattctgtaggttgcctgttcactctgatggtagtttgttttgctgtgtagaagctctttagtttaattagatcccatttgtcaattttggcttctgttgccattgcttttggtgttttagtcatgaagaccttgcccatgcatatatcctgaatggtattgcctaggttttcttctagggtttttatggttttaggtctaacatttaaatctttaatccatcttgaattaatttttgtataaggtgtaaggaaggcatccagtttcagctttctacatatggctagccagttttctcagcaccatttattaaatagggaatcctttccccattgcttgtttttgtcgggtttgtcaaagatcagatggttgtagatgtgtggtgttatttctgagggctctgttctgtcccattggtctatatctctgtattgttaacagtactatcctgtactgtagccttgtagtatagtttgaagtcaggtagcatgatgcctccagctttcttcttttggcttaggattgtcttggcaatgaggtctcttttttggttccatatgaactttaaagtagtatttcccaattctgtgaagaaagtcattggtagcttgatggggatggcattgaatctataaattaccttgggcagtatggccattttcatgatattgattcttcctatccatgagcatggaatgttcctccacttgtttgtgtcctcttttatttggttgagcagtagtttgtagttctccttgaagaggtccttcacatcccttgtaagttggattcctaggtattttattctctttgaagcaattgtgaatgggagttcactcatgatttggctctctgtttgtctgttattggtgtataggaatgcttgtgatttttgcacattgactttgtatcctgagactttgctgaagttgcttatcagcttaaggagattttgggctaagacgatggagttttctaaatatataatcacgtcatttgcaaacggggacaatttgacttccccttttcctaattgaataccgtttatttctttctcttgcctgattgccctgtccagaacttccaacactatgttgaataggagtggtgagagagggcatccttgtcttgtgccagttttcaaagggaatgcttccagtttttgcccattcagtatattggctgtgggtttgtcataaatagctcttattattttgagatatgtcccatcaatatctaatttattgagagtttttagcatgaagagctgttgaattttgtcgaaggccttttctgcatctattgagtaatcatgtggtttttgtctttggctctgtttatatgatgggttacgcttattgattgcgttatgttgaaccagccttgcatcctagggatgaagacaacttgatcatggtggataagctttttgatgtgctgctagattcggtttgccagtattttattgaggatttttgcatcaatgttcatcagggatattggtctaaaattctctttttttgttgtgtctctgccaggctttggtatcaggatgatgctggcctcataaaatgagttagagaggattccctctttttctattgattggaatagtttcaaaaggaatggtaccacctcctctttgtacctctggtagaatttgactgtgaatccatctggtcctggactttttttggttggtaggctattaattattgcctcaatttcagagcctgttattggtctattcagggattcaacttctttctggtttagtcttgggagggtgtatgtgtccaggaatttatccatttcttctagattttctagtttatttgcatagagatgtttatagtattctctgatggtagtctgtgtttctgtgggatcggtggtgatattccctttatcattttttattgcgtctatttgattcttctctcttttcttctttattagtcttgctagcggtctatcaattttgttgatcttttcaaaaaaccagctcctgcattcattgattttttgaagggtttttgtgtgtctatctccttcagttctgctctgatctttgttatttcttgccttctgctagtttttgaatgtgtttgctcttgcttctctagttcttttaattgtgatgttagagtgtcaattttagatctttcctgctttctcttgtgggcatttagtgctgtaaatttccttctacacactgctttaaatgtgtcccagggattctggtatgttgtgtctttgttctcattggtttcaaagaacatctctatttctgccttcatttcgttatttacccagtagtcattcaggagcaggttgttcagtttccatgtagttgagtggttctgagtgagtttcttaatcctgagttctagtttgattgcactgcagtctgagagacagtttgttataatttcggttcttttacatttgctgaggagtgctttactttgaactatttggtcaattttggaataagtgcgatgtagtgctgagaagaatgtatattctgttgatttggggtggagcattctgtagatgtctattaggtctgcttgttgcagagctgagttcaattcctggatatcctttttaagtttctgtctcattgatctgtctaatgttgacagtggggtgttaaagtctcccattattattgtgtgggagtctaagtctctttgtaggtctctaaggacttgctttatgaatctgggtgcttctgtattgggtgcatatctatttagggtagttagctcttgttgttgaattgatccctttaccattatgtaatggtcttctttgtctcttttgatctttgttggtttaaagtctgttttattagagtaggattgcaacccctgcttttttttgttttcccattagcttggtggatcgtcttccatccctttattttgagcctatatgtgtctctgcatgtgagaagggtctcctgaatacagaacactgatgggtcttgactctttattcaatttgccagtctgtgtcttttaattggagcatttagcccatttacatttaaggttagtattgtcatgtgtgaattagatcctatctttatgatgttcgttggttattttgcttgttagttgatgcagtttcttcctagcatcgatggtctttacaatttggcatgtttttgcagtggctggtacaggttgttcctttccatgtttagtgcttccttcaggagctcttttaaggcaggcctggtggtgacaaaatctctcagcatttgcttgtttgtaaaggattttatttctccttcacttctgaagcttagtttggctggatatgaaattctgggttgaaaattcttttctttaagaatgttgaatattggcgcccactctcttctggcttgtagagtttctaccaagagatcagctgttagtctgatgggcttccctttgtgggtaacccgacctttctctctggctgcctttaacattttttccttcatttcaactttggtgcatttgacaattatgtgtcttggagttgctcttctcaaggattatctttgtggcattctccgtatttcctgaatctgaatattggcctgccttgctaggttggggaagttctcctggacaatatcctgaagagtgttttccaacttggttccattctccctgtcactttcaggtacaccaatcagatgtagatttggtcttttcacatagtcgcatatttcttggaggctttgttcgtttctttttactcttttttctttaaacttctcttctcacttcatttcattcatttgatcttcaatcactgataccatttcttccacttgattgaattggctactgaagcttgtgcatgcatcatgtagttcttgagccatggttttcagctccatcaggtcatttaagttcttctctacactgtttattctagttagccatttgtctaatcttttttcaaggtttttagctcctttgtgatgggttcggacatcctcctttaactcggagaagtttcttattactgatcgtttgaagccttcttctctgaattcgtcaaagtcattatccgtccagctttgttctgttgctgacgagcagctgcattcctttggaggagaagaggcgctctgatttttagaattttcagcttttctgctctgttttctccccatctttctggttttatctacctttggtctttgatgatggtgacgtccagatggggttttggtttggatgtcctttccgtttgttagttttctttctaacagtcaggacccttagctgcaggtctgttggagtttgctggaggtccactccagaccctgtttgcctgggtatctccagtggaggctgtaaaacagcaaatattgcagaatggcaaatgttgctgcctgatccttcctctggaagcttcatctgagaggggcacccagccatatgagatgtcagtcagcccctactgggaggtgcctcccagttaggctactcagggatcagggacccacttgaggaggcagtctgtctattctcagatctcaaactccatgctgggggaaccactactctcttcaaagctgtcagacagggatgtttaaatctgcagaagtttctgctgccttttgttcagctatgccctgcccccagaggtggagtctatagaggcaggcaggcaggcctccttgagctgcgctaggctccacccagtttgagcttgctcccccagcctcgctgctgccttgcagttcgatctcagactgctgtgctagcagtgagcgaggctctgtgggcatgggaccctccaaaccaggcatgggatataatctcctggtgtgccgtttgctaagaccattggaaaagtgcagtgttagggtgggagtgtccccattttccaggtattgtctgtcatggcttccgttggctaggaaagggaattcctcgaccccttgcacttccctggtgaggtgatgccctgccctgcttcggctcatgctctgtgggatgtacccactgtctgacaagctccattgagatgaacctggtacttcatttggaaatgcagaaatcacctgtcttctgtgtcactcatgctgggagctgtagactggagctgttcctattcagccatcttggaacctcatcagtaggagagtcttcagctcagtgtctcggtttgagttcttgttataatagcactaggcataatactgggcatacagtggatgctcaggagatgactatggaataagcaagtaggatagggtttggagaggagaatgaggcttgggctgaaagctgaactgagttctagttttggatctcttgctaagcatgtcatcacttgagtctcttggacttgactttttttgtgtgtgtgaaattggagagtcagaggtaggttggggatcccaggcattccatggttctgggatagtgacatggtttgaaggaattagaactgtagtcaccagatgtggcaatatttagagagatgctttagctcaagaccagctctatcctgataggatggcagaaactggagatagaagccccttgtgacctggcgcaggttgaagaccctctctggaccacacttgagccatctgtagaataaagaggaagtggctgcttttctagctctaggtcctctgcttctaaatactttttccatcagcagctgtactaagtgaggatcccatgatattacttggacaatgccaaacattggtgatagaacacattcagcatgtcctggagatgctggggactcttgtttcctgaaggagactgtcaagagggtaagatagagcctcttttcagtcatgagctctctgctgtagtattctcttgcaagtttgagaatgatctaaatctgggcattcagagggctgttgattctgaatcttttagaggggaggcaattgttaagataatggagtacaactccttcattcttctcacgaagaacctggaactctggagaggtgaactacataacaatttagcaaattaatgagtaggctcagaccagcactttggtgacttctcatggaaagtttctttctatactaagcctactcctgccttcaaggagttctatagatttccattgtcagtatcaagtaggtggatgtctagggtgtagcacagtgcctgccacatatagcaggtgctcaataaatactggccaaagaaacaatgtgcacaactgttacaggctcttccaatagtaaagactaggatttgtcatgtggattccaagttagtagtcattcttcca

SEQ ID NO: 1165 - DNA, 4246 bp, Homo sapiens
cacagactgtgccttctgactgtgttcttacacgacgaaaggggcaagggatctctttcagacctcttttgtaaggacagcaatcccaatcatgaaggctgtgctcccatgacctaatcacctccccaaggcctcacatctaaaaccatcaacttatgaattttgtgggggacatcagcattcagaccatagtagggattaaaggcagcaaacaaagaactagctgaactggagacaaagaaattattctgtgtctgtggaagaatggattaagaaagagtgggcaagcaaggagtagggacaaagagaggagggttgtttttgcatctggcccttaactcaacaactttcttttgtatctctccactttcaggattcactgaggttgttgggctcctgtgggaataggttaggtggacgcaattatcatggctgataaataaatggcattatagtgtcacaatgaaactcagcacttgagaattcacaacactgggcagtttatgaagtactttctcatggggtcttatttgtgccttcgatgacctctgaagtgatattgtcaagaagactggacagacctgtcatttgaccagcaccccttctccctgtgaggagaaggggcatggcaatcaaatcgtcataagctggcccagtgagaatggaccaaagtcccagtgtttaatgacattaggcaaatagttgggcagcacactgggccggtgaactctaagggctggggcctccctttcttgggatatgcactgtcaactgttgcctctgagtctctctattatggggtcaaagtagagctctctcccccttctgatggacactttttttgttgttgttgatgttgttgctgtcctgattaatgccatggatacaaataaagccagttcattgctcttgttgcagatggcacgaaaaacattttgtctcagatgccatttgcacaagtgacctcatccattatgtattggttttataatttagcccagcctttcagatgcccatggaatgtcacctactcatgggcattattattcacagcttataaaaggaaaacaaggcttagagaagttggtatgggagatttttcagacattttttttcagaggttcatgaaagccataaataaagcctctcagaaaatgggagaatctaatgcaggtttatgactccaaactctgagttctatgcaccctcatgccttctccacgttggttccctgcagagttagaatgaggagattcccattgtactgcctcttttattgcacaatcatatctggatgtgctatattgttgtgtgaggttggatgatgaggaacagggaagcttgagagaagtctggatagagaagagtaaacttgaagaaagtaggaaccaaacaaagcaggactatggagatgcgtactttctcccatcttggggaaaaatgagtgatttagtgaaatagaggacttgagagataggtgcaaaatgggtgatgccatgaccaggacctgcagtctgacttccaggctgggctagcctaatctttgtccatcattttttctttcactggagcacctctcctgctaatacatggctgtgtcactgggtgacagaagctgttgtcttgccatcaagaacacttggaggtgatgggtaggaggcagctgctgtccccagaggtttggaatgcagcaggaacagctcccacagtggtgtacaccctgattcattttcaatctaaaataattaatgtttgatcaacagattaaaaatgtaattaggaatgggtgcatgttcattcagatagaatatcctcgggcacactatagtctcttttcctctccactcatgcccacctacaggtggtgttttcagactcccaaaccttttcctttttctttttttttttgagatggagtctcgctttgtctcccaggctgaagtgcagtggtgtcatcttggctcactgcaacctcagcctcctgggttcaagtgattcccctgcctcaggctcccaagtagctaagattacaggtgcatgcaccatgcctggctaatttttgtattttcagtagagacggggtttcacctggttgaccaggctggtcttgaacttctgagctcaagtggtctgcctgcctcggcctcccaaagtgctgggattataggggtgagccaccgtgcctggcctcctttttctgttggagtgtttatctttgtctgccttggccctggcaagattttttttctcccattatcatgatagcaagtgaattagtgagtgttttagatcacatcttacctccaagaagaaaggggagataaaaataatctcatatttgctctaggtttggtcagctcattcctgctatgcaagcatgttaaaagcaaccactataaaaagaagaaattaactctgcaaagccaaaacccagaattataagagatgctcagcaaatcttcactatggtcaggctcttgggctgggcaggtaccacccgggaatgtaagtgtgaagtcaagcatccaaacactgtgcctgggcctaagcagactccatatgggactagctcctttcctcactccctggttctgatggaaagtcatggatgcttggcctagctgtgatgatatgatgtggaaatttcagtgtcctgagcagaggtgctgggaaaggaatggtaaaagttccctggggcagtgtgggcaatagagcaattaccatgcttcccactggacttcacaagagcctcagaatccagatgatcctcttctgcccttctctagaggataagccttgctgctttcccagggaaccataattcttcagcacttgatggtgaaattgtctgtttttcagcatctcagttccacaattgcacctcatttacagtattgcttaagtgtccctgagggcccctgcagagccaccagagagtttgtccacaaagagaaaactcttcaagcctttacctcccaggatcttactgcatctgctggcctatctggtagaaaagctgtaggattttgacttacatttttttggggggagggagtagagtcactagggggttggcttgagccaggatgagcggagaacccatggaaacaacttaagccaacttgatttctttcagaatcccatgtgctcactcaaagattgcatgggatttactgttaaggaaccaggtgagtcaaaatctttctaaagagattctgaaaaatatctcttattatttcttattaaatttaaataactctttttgggattataaataaacttttcattactcacttgaaggtaataaatcctgtgattattctgctctgaagtattatgtcccagcttgccttttcctgccatccaacttgtgcctagctttacctcacccaccaccagttggtatgtgtttaagaaatgaaaaagaattttaatatatgccaaggtaaaatataattagtcttgtaaatcttctgtttaaaagggcatgaacaaattccccagactaaatagaaattacttctggattgtcttctattttcaattatttctattatctgtcccttttttttatcatgggtaatcaaaagttgatcatattttcaagaaactgagccaaaacaaagcagagtaaacaaaaaaccataatcaggggacaaggtaggggggaaaatgtgaatgagccatatagatgctttgtgcatcaactgtgtgtttatctatccatccattcatccatccatccatccactatttagtttgtctgtacatgtgaagtatgattcttagagctggatatcagggtagaaatcccaaaggctttaaagttacaatggcctgggttataattttgactttaaatttatgctagttgtgagttctacaaaactcacgatttctgcagcctcaggttgctcatctctacaatgggtttccaaacccctcctttacaggggtttgctattatgtacctggaacaataccttgtatatacgagtttcataaatattgtctctcttgtttcacgtttccttatccttctcctgattaactgataggcaccttgaagaaaagtcacattaaaatggagcttacccagaccttcctgtcttgtcgtttttgttaagagaagtaattgaagaaaataacagtgaacaatgtggcacataagacggcccaatgcactctaaaagttaatgttttccaaggatgtctcataccccagaagatgagactcaagcttgca

SEQ ID NO: 1166 - DNA, 2303 bp, Homo sapiens
tatggaacacaatttttcactacagattggctccatcttgagacaggtcagtcactcattaaattcaggttgtatctgggggatgactgcctctttggcaaggtggtgtgtagataccaagggcaattacctgcaggaaaggccagctgtgaccaattagcaaccaacattgacaacaggtggggagtgggtgcacttgccaaataaagaagatgtgagtgacacaccaacagtacctattactcctaaccattcatttattctgtcattcatgtatcaaggtgaacactctttcaggggctggagataccaagataaatgagaatcaatctgtgtcttctgtatgtcaagaaagtgattgaaataacaaattgttattgtaaatgggccatgccaggtaaatgaaataatcactttgtccatggcatataaaacaatacagctgacccagcagttctgaggtgctcccttcccatttgaggaaacatattcacaacattgaaataatttgttcaacatctcacatattgttttctcattcattttaacaaagagctattaagcaccttgctaggcactattgttataaggagaaataagccaagacctaaacttaaggagctaactgcacagtggggaattgagaagtagatcagtgaatgcagaacagtctgggaagtgctacattaaaggtcaactgaggaacaatggattcacaggggaggctttgcttccaggctgagaatttgcttgcctttcttgatttctaattcagttctcctttactaagctacagacagaaccactggaggggaaagagttcttgaggaattcccgagggtttacattaaatcataatcatgttaaatgtatcagtcattccattatgcactgctagagtaaactcactattaaaatttatcatggttataaataaaaatagtgtgttgttttgcttccataaatttaactatgtgttctaaaataaatataatcacatttattggcacacttagaatgggtagccttgtgaaaattatttctacatgttaaaagagagcaggggaaagaaactatcaggaagaacatacagagtattataacaattggaaaattatttttatacttaatagaaaacattatgagagcatgtttgaaaaaatcttacttcacagcactttgattatgttgcccatacactggaacgcctcctgttatttcatcatcaattaaatcagagaaaacattacaaaaatgaaaacatagtacaaaacaagaaaaaatctttatgctatgctttttttctattttattgaaaataatagcacatttaaaaaaatttcttagacattttaaatatcttctgattcatcatgtttcctgattttaaaattactatttcaggactgggcacagtggctctggcctgtaatccctgcactttgggaggccaaggcggacagatcacttgaggtcaggagttccagaccagcctggccaatatggcgaaactccatctctaataaaaatacaaaaattagctgggcctggtggtgtgtgcctgtaatccagctacttgggaggatgagggaggagaatctcttaagcctgggaggcagagtttgcagtgagccgagatcatgccactgtactccagcctgggcaacagagtaagactctgtctcaaaagaaaataaataaataaataaataataataataaattgctatttgatcatttgggaaattttgaaaatataaaaatgtatatgtattataatcagatgtttctagggtttgacttgtatcaggcaagctgttgagcagttattttttgtcagaatatgagagtaacttttactagtttgtaaaaagtattgctttttgctaaattttaattgaatttagataagtgtctatcatttgatgtaagtatatgaataaatagatgtactggtacaacatatcatattgctgagtttggtaaaattacattgctgtttgtcacgtcttttatcccatcgtgaactatggcagactgtatcaagtagcctacattccttactcctcttcacagccatatgctttgccatgtgactttgaagtatcttttagtgaaggagtatcatatgtttccctatctcttgattttgggtatagtcatacaacttgttttgccagtggagatagaagttattggagctcaggacacattaccccaaaatatgactgtaggaaaccagaatatgccaacccaataccatacttttttgaaatattttgagctggttatttttgagaaat

SEQ ID NO: 1167 - DNA, 2093 bp, Homo sapiens
gagtggctggaataggacagtttctttatcagcatcatcaatgaatgttcttgaggcactgcatgtgaaatacagggctaagcaaacatgtttaagatatgcttcttttcctagaggattgcaatctacctaagaagcaggagctaaataagtaataaaatgcaattcaaagtcataaaagtggggagtgcaaagaatgaggaatgggcagttgcatatattggttattgccagaggctgaaccactggtgtatgtcctacaagagagatattagcctatcctgacaccttttgatgaaaatattgtgcccattttacagataagaacaatgaactaagagagtagagatggcctcccccgcagtgtaatttgccagatcccactacttactctgtgagggaaaaaaaataatgagtgggctaaacaataggaattcaaggtaatgtgtttgaaagccaaggcccaacagagattctcgaagtgtggtacccagacaagaagcatcagcatcacctgggaacctgtcagaaatgcatatgtttgagccgcaaccgaaacctgctcaatcagaatctaagcgtctgggcattaaggcttagcaattcgtattttaatagggccccagaggttatctggaggcaggctaaagttgagaatcattgacccaggaacaacgtatttcagctggatggggaagcaggcaatcagagacagaggcgagatggtgaggctgggttgagtggcaagcagtgataatccaaagctctgagatggcagcctgcagacctggctgggtgtgaatgggcctactatagcacccctcagtgagtagcctggtgtcctgctgaggataaaatgtgaggactgttcccagctttcttagaccacgtggtcctgctatgtcattactctgaagacagggatccctctgcctgagaatttagatagctggttgtcccttgtgagggagctcctctgcagcctcaagggaacttcaagaaaagaggtttatgaccacttaaaaatactcatggcttcatttggatgcttataaagcacttttaatcatgatgaaatgcaagtattgcctttgaatgccttgagttgaagggaaaagttaacgagtgaatgatttgaatcatttctcttcttagcctggagcaagccattaaaagaatgaaacttctagtcaagatggaaacagcctgccccaaagggatgattgaaagagtcttcaggacaggcatttgtcctttagttttattttcactttaattattataaaatctgatttaagtgttgaccatagcctccagttccagccagctgaaaagataagcacatttgtatttgtgtggacaagtctgcagacttcttattgttgtctcaagccagacaatacaacccttttaaataacagttcctcataaggtgagattaaagatatttcttcttgctgttaccaaggaaaatcatgatctagttgattatgtacatgaaaagaaagtatctcttggctattgcttggggttgtgacatcatctggtgtccactatctttactttgggtaaatcattgctgtaatattgatgaaattacaaaataatggagaatcagaggtcatgttccccaactctaactataatgaaaactttaaaaatgtttagtcccaaattctccttggaaaacattggttacaggtaaaatacataaatttatatcaaacttagttgtgttgttgttgttttcaatgagctatacattagataacctagaactaatcaattgctgttgagctgtaatgaaatgtaaacaagtggaccttgtattttttatggcattctgaaatttaaatctaactgattgtagctaactgaaccttaaggaaaaatcagaggaaacttgatcctgaaaacattagcacttagcattttgtacgtacatatgctcaaatatgtatccatggtatggcaaaaaaatatcttactgaagcctgtttcagtttcttcatggaaatttcagttgattgtccattttagtaaataatatagagcatgttattcctatcaaccgatcctgtcaattaatttag

SEQ ID NO: 1168 - DNA, 1828 bp, Homo sapiens
caacagaggaaagtattggggaaggctctgagcagaggttctgttccttcccccaccccaggcagactcctggtttggggaggactcagagatggggtcatcagattgggtggtggagccggaccacttggtttgaatcccggtttcaccatttcttagtcttgtgaattgggtaacttgtctctgtgttttaatttcctattctttaagatggagatagtaacaataataataatatctactttatgttgttatcttgagggttcaatgagtaagtacatgtaaaacacataaagcctggtacataataatcaccaattaaatttattgttattattaatacccgagagaagagggatctgtgtagggtttcactttgtctctaattttaaacatctctaatatgtaacatttcttccacattttttttcagttgcatatgattcagactttttacatttgggagtttaaaattttattaagtaatactactcattgctctttaattatacaaagaagcactgagaatgacgaacttcttacaaaccctgagtacattgcatgagatccaaaatctgtaaatcatgtttgatgatacgctttgtagaaattctagatataatttcaaaaagatcaagtgaattaacattcaaagatgaacgcgattattataagcagtcacagcatccctgtcacctgccattaacaacatttacaggcagaatacacatgctattcatccatctgtggatacctgcaggtttattggactgaaagattatgaggcaactatatcccgataaaacttggaggaaccacacattgaggagaagatttccacaagcatagagctaatgcagacaatttgaaaaggattggcttcatgctgtcatgaaattacaattgcaattgactctgggggaacacttgagtggacttgagggaaatggcttatgggataatcccagggccttacatggattgactagccccttcttggtagtgatgtcattcctttcctctgtgctacacacgttcatgtgcaaacacaaacacatcccacactccaacaggaagcacagttcccccaagtgcagctgcttaggttaccatagcaacccttgtagccaagttcccagctgaacaagtttcacaagacaccagaatgttttcttgcactgctcttccagaattgggctgagatggatccaagaatggcctgcagtgagggcagtgggaaaggccccccaaaaacaccagactgacatcaagtgtggctacagggaaggaagactgcctatgtacttggagtgacttacctgggaagggtgaaattacacatccagcccctctcaggacactctgcaggactcatggttcaaggaggtgagaacggctctgtgcagaaccatggctgctaatacccaagttccaggctgcagataggtactcactttcagcctcgtggttggagggcttgagctgaacagaaaatccccatcttcttctaaaaaaacaaaacaacctaaacaaacaaaacaaaaaatctctaataaaattcatggtcaaaacagatgaatgtcccttataccttgtctcaaggttttttgctgccagttgcctgttactgatttaaaccaacagtccccccctcagttcccagcacattcattctgtgaactggaccctgggtatggggacttggcacaagaactagaacaaggtaaaggaattcactgtgagatcttgtattccatggcctcctcatactcagaccatgatcaaaatctatttaggcctatttagggctggccaatacgatctaaaa

SEQ ID NO: 1169 - DNA, 1707 bp, Homo sapiens
agcttgtcttcccactgttcccctcaacacaaactttgagaccctgcagagcctggccaccatctgtcatgtcccacacattcaccccttccctctgaatgcagtggtctgcattcagcacccaccaccagacctttgtccatgctgggtcctctgtctggaatgttccttcttcttgtcccttgttagttcttacttcactttctgatcagaactcagtcatcacttcccgaggtcgcattccctgaggtggactcttacggcatcacagagatgattttatattcaattcatgcttatccctgcagtggactgtgagcaaggggcatgtccgatttgggtccctgttggaccctcagtgtctagcacagtatttggccactgtgggcactaaatcaatatccactgaatgagtgactccataagacactgatctaatccagtggcatttgggatagggtcagtttattgagcagaaaatcaatggttcctaatgaaaggattggggcagatgtcagaatctccttgacaggattttcaaaatagcccttgccaattgcttcatctctatccccaagattccttcttgagggaacagggtgaattttttattcctttccctcatgggggaaagaaactatgtgaactttaaagccatttgattggcagtagagtccttggaagaccaaggctttggcaccacactgtcctgggtttgagccctagctttgccttttatcaggcctctttgaaccttagttttccactgtgtgaattagggatcagagcacctatcccttagggttgctatgaggaaaatcctgggcatctgatgctgcctgatgaactttgtgtggggttgctcctctcctggactcaaagttagcagttagaaagtcacttctttcaatgtcctttttccagattttcattctcttcattattccttgaacaaggatgttcaagacctggaaagctttatttcaacttccctctcttgtccttcctgggtcttactgtggtctgtctgccattctgcagggcctccagagaagaaggttgaaaagatgaggttgttctatcgtcagaggtttttgctaaccatacaattgagtttagtggagtgattcatggacatgcatttacagctgaagttgtagatctgtttttagaaattattagcaggcattaaacaaaaacaggcttaattaataattcaccagaaaaaaagatatggtgcaatatcccgcaatagtaatctttagtgctggaataagtattccatttatttgagttgtttttttacttcctttcaccataacaaagacccaaatcctctgtaaaatgaaagagaggcaggtcttacagaacgtatttatcagctcaggaaggtctgattctgcctctagagtccccagaaatgcagaacaaattcttggtgccaatattcagaaataaagtggaaccattagaggcaaaaatagggcatggggtcagtgtttctgataaaatataagcctctgctgtttaagcctctgctttgctttagcttcaaggcctcataaactcacagatgtatcagttcctgttggcaccccacccacactcctaaggcccactctgaaggtccctgtaggcagcacctcctttctggctcttcctgcctgaaggctttctcgagcttcagagcagccttggcacaaaagt

SEQ ID NO: 1170 - DNA, 1980 bp, Homo sapiens
gtgtccagaccctgtccgctaaaagaaggcaagtcagacctgaacttcctagccacaataaaacatctccttcctccttctttcattcttccagaggggaggcatggcagggagttccactgggccatccagcactgcttttatttgtaaaacaccacttcctcgtgtctaaatgttctgggattcatatttttactcaccataacattgtccatgagctggtggcagacagctacaattcttcattttgaacaggctgcatctactagcatcacagcctcatgccaaaacttgttaatgccacatctgtatttttatgaatcgggtcctaaaaatttgcatatgttttcaatcaaaaaagactaattcctttctagtggtttaagaaataaaaacttgtgttctatctttgctcaattacaagagttcacagtaagagctcaaacattcaaatgtcgaggcagaggtggcactaaatctcacaaggtgcctcgatttgctcctccattgcctacctcattgatgttcgcaaacccgaatgcctcttgggggatccatggaaagcaccttcattcaatgtaaatgaagaagtatttgctgacacaaatgatacctacattaagtggattttcctgaagaacaattatggagaattgaggagctgctttttctgcattttgcaaggcaagatagggaatacagttaggcctccaagagcacattttcacaattgaaagtatgtgtgagtgtggggtttggggggttggtggtgagaggacagtggttgaatatgctttgccagggatgcctatgatggcaagaacttgctggaaaagtgatcccgtggagtctctagaagaaacccagaacaatgaggctggccacaggtaaatcttaggcataagaaaacaagagtgtggatgatccaacagggagggggagtataaagagaattgggaagcagaatataggaatatatgtttggtgtaggcagcatagactacataattagtggcgctgagggcaaatgaacatgtgaggccccttctttgaaaaacattaggaatttcaagacagtgacagcagagttttaacctaagagtgaagcccttccaagtgtagggcctgtggactgcacaggccatacgctgataaatccaggcctgggtgtgaggtttaagaggggaaaggctagctctagggggtgtcaaaactctttagaaaagtaaactttccccggtccaccgtgtgctcggaaaataccactcttgaatgaccatagtgagacaaataaatcatgtctggacttagcctccagaagtggcaaaaaagggaggagctgatggggttgttatgctaattccaatttgttgtaatttttagagtgactttttctaaattatgttcatttcagcaccaaaactccagattcaagtcagagccttccgatgctattatgagcatattactgatgtctagtaaaataacatcttgtgatgtttcttttataggggccataaatcaaaacattgaaaacagttaatttttaatgtaccactattatccatctttagttataaatttaatgtctcctaaggcctcatggattgtaatgcaactcaaaacatgcaacggctgctcaaaaacagaaggttcccccagtatctcattatttaaatccttaaagatatggttttaaaagcctgaggatatctaagcaaacttgtttaaaggagtcataaagaaagataagtagttttcctctgaagcatatgaaatttattacagcatactaaagtaggattatatattgactaaatttctaaaaacatttattttctggtgtgcatggcatttggggaaattcacgaagaaataaaggggatagggcttaatacaatcgtctgcatttgccttaagcaaagcaagatttcctacgggtcttggagccaattccatcctgaggataacaacactgtt

SEQ ID NO: 1171 - DNA, 4613 bp, Homo sapiens
actcaatattctatgttttaaggggagctgcactaagaggggtaagaaattgaaagcaaccaaaaaataaaaacaaacacactaagtctgttttagagataaggccattggaccatggaatacacccaaggacatcagaagggccatcaggcaccatcagtaagagcagatgatggcagccaagccaacttgagtagtagagatggttcatattactgcagggacaggggttaggcccacaaggtggttttctgcattttcccctgggagatgcatcgtaaatcatacacaggcatgggtgccagggtacaacccaggaaacactgagacctgcagtaacagcacaacttccttgtaatcttcactattgctcccatgatgctggctccaagtcatgactcatacttaggaatcaaatgttctcccagaaacactgttttaattacacatgccacttaaacagaaaggaaggccataccttcccattgatggaggcagaggcttaaagctcagccaatcctctgtctgaaggattcaggaaatttcccggtaagacaaggtagagaatgaacactatatctcctgctaaatgaaaggaaggacattggttgaccaaagccagagagacggaggaagggagggaggaagggaaagaaggctgatccacagatcaagctactaggaaatcaaggaggaattttaagtgttagagcttcaaggttcctcagagatcattttatccaacttcctgttttatagataaggaaaacgggccaaaataaggaaaacacctttagattcacataacacattggtaggagagagagggaagtggtggaacaagggtacatcacaccttcccattccaagatgctgcttttgccagggtctactatccaagtcctcagataaaccagccccttctttcaccagtggattcaaacccatgttggggaaggaaagagataaggagaagtaaatgggagataaagcagccacactctagttctggaatactccgaattattgattttggtggtggatggatggcccctttcagctgcactctcagcgcctgctcctgttttatgggtgtttccagtgtgcctcaaattatcttgcctcttatgaaaatacaggaacaattacatacaagcctattcagaagggacaattagctatttacatcagcaaagaaatgacagtgggctcttcctgacagatgccatcctcacactgtgttagagcagagagggaccttgttctggaaactgtccaatagctggaaggagacacctcctctgttattgtagtgtctttcttgcatttctgagcctgagctttctagacttctcaaaatgctatccagcaattggcagacccatcaattgaggatattggctcctcatcacctggtctcctttgggaggggtacacaggatagttgcaattggtttttaggacagccacatgcagaaacaaatggtagtcagactatgcagcagtataatgagcatcatttcctcatgatacttttatgatatagaaggaaataaagaagtgaatctgtggatggtaataaagtaaagaatagagaaacaatggatcaagatggaaaggaatgcaatgagaaatagattaaatgcataatcaaagcttaggaataaactcctgatgaatcaaaatgaccataatttaaaaacaaaaatagatctgctgaatttcaatttgaacaagccattcaccacataaaaaataaacatacagtatttcaatcttagaatttaagccctattttcaaatcaattaatcaaatactcatgcctgccaactctggcactagacatggtaggacataggagggaaagataaaataaaccagtatccttatccaaagtagctcgaaatccaatttgtacaaacaaggtgtacatgactgaattagtgaaaaggagaatttatacagtgagaagcagaagcaaatagggcagtgacacagcaacaccacatgtttcttctagtgaccagagtaactacctgagtgtcaattttctttgtattgaaaaaagggtgaatacagagtgacttgtgcttcactttaaatagaaaagtatttaatctatcaatgtaactttaaaagtcaaattgggcaaaactacaaattagtcttccatgctttagtctatatacctgtgctagagtgctctttccaaaacaaaaatctcatctcatactcttgttgaaagaaggaaagagggaagaagggagggagggagaaagggagggagggagggagagagggagggaggaagggaaaaagaaagggaaagggaaagggaaagggggaggggaagggaaggaagggaaggagggtaggaagggaaggaaagcaagggaatggagaataaaaaactttaatattccctcattgcttacaaaacaaaatccaaattctttagcatggtttataaaactcagtccagctccgtggcctagcctctgcctaaccaagttcattctcataatatgctgctaaatttaaaagtagactacagagcaacatgtacattcacactaagtgaataagcctgtcagagaaggggcaaatagtatatgcttccacttgtatgaaatacctggaacaggaaattcatagactcaaaaaagtaaattgaaagttactaggggctgggggattgggaaatggagagctattgctaagtggttagagagctcccgtatgcggtgataacaaagcttgaaaaatagtgtcgagctgtcaatagctgtacaacactgtgaatgtaattaataccattagattgcacacttaaaatggttaaaaattttatgtcaaatgttatgttacacatatataaacacaattttaaaaaattaataatgtaacataccaaaaaccattgaattgttcactttaaatgggtgaactgtattaactctatttaaataagctgttacaaatgtacaatatgtacatacaatactaatgtaggagaaaggcagaggaagattctcctaactgctaacagagattacctctggatggcaagatgcaggggatcctgttttctgagctttcctacatttcccaaatttttattagaactttgctttgtgctacttttgtatccataagagaagaataattgccatttttaaaatgttaaaactttaagcaagataaaaataagatataagccttaatcttctcccgttggggctcataacacatggtggtggaatgccagaagggaccctgggcactcagtactgcctgcattcttcttcgctgggtgagcctctggccacatgaatgtctgtgcttatgatgctggtggcccaaagagcttaatgatgcaaccagggactctgcaggaagactgctggagttccaccactcaccaagtacctctcatagcctatgtttcctcatcggaacaatgggataataatgttatttacttcataaggttatcaaaaaagtaaatgagataatttacatgaagtgtttaaaacaatgtctgatacccagtattctgacctaagtgtttcatcaatgattggcggctattatttttactgctgctgttgctctattacactgatgtgagtacagtcatgtgctgcataatgacattttaatcagtgactgtatataagacaatggtctcatcagattatagactgtatttttcctatatcttatctatattttgatatgttcagacacttaaatactaatcactacgttacaattgcctacagtattcagtacagtaacctgctatacaggtttgtagcctaggagcaataggttatctcatatagcctaggtgtgtagaaggctctaccaactaggtttgtgtaagtacactcgacaacgtttgcacaatgacaaaatcagctaacaacacgtttctcagaatatatccagtcattaagtgatgcatggctgcatttgttatctatcctctaccagagcagggattggcaaaccatggccaaagggccaaatccaacccatcacctgttttgtatggtccacaagctaagaatgtttttaaatttttaaatgcttggaaaaaacacaatagtatgttatttcatgacacacagaaattatataaaattcaaattccagtgttaataataaagtttaattggaacacagacactcctatttatttatgtattacctatgtctgctttcatgcacttgggacaaagcctgtctagcctgcaaagcctaaaatgttcattatccgccccttgacagaacttacttgctggggaataaattctgaaagtaaagaccagctcttgttcatttagagttaattcatggttagattagattggagttcatatttactgagagactaaatatacaaatggacatggccagaccatgtataacagaactctgacctacaacctctgcagcaaccagcctgggaagccaggccacaacctctgcagcaatctgcccagaatgatcagggtttagtcagtgactgccagcttccttactttttgtcccttcctccaaccaaatattctccccaaaccaatcatgtaagatactctgcttc

SEQ ID NO: 1172 - DNA, 3876 bp, Homo sapiens
gcacctccccccatcacgatcccttaacatgcttaactcaatgaactgtttactgtcctgtttctccgattagaggcccaatgttaatatcaattaccactgtatcctagtgtctagtacagtgcctgccacacagtaagaattcagtatatacttgtcaagtgagtaaaatataccagttttgtgacaaaaaatatgcataggaaaaagaccagaaaggaacacatgaaaacataaacaatcttctactagatggaagagtatgatccttttccttgatatacgtgtctccattttgtctgcacatagacttgtctgtgcaatgtctataatgcagagaaagaaatgcctgaggatgccataagacagatcttttgggtcctacagagtttactttcataattttataatattaagattgttgccataaatttccaaactcaaagacatttatagtagattatcatctcacttgtcaatttgtcaacctgaaaactgagttcttaagcaccatgtagaaactttcaaatataagttaagatatcaacacctgcagagcaatattatgcataaagatgtaaaattaatcatttcacacattaggccccccaaaaaagataacaaatgggagatcatatcgtattaaaaataaccatgtgagattctttggattgtgcggtagcacagctctcaccaaacttcaaaatactctggaattcgggtgcagtgattcatacctatactctcagctactcgggaagctgtggcaggagaaccacttgagcccagtagttccaattcagcctaggcaacatagagaaaccctatctccaaaaaaaaaaacaaaaaacaaaaacaaaacaaaaaaagtatcggagcatccaacctagcaagcaatattgccccaaaatgcaatcaattaagtggaagattttgcatgcatgtatgtgaatttcacatttttatcctgagtcaccagatcacaaaaccagcaagctcaatcttcttgaagggagcagatcgcccgcccagaagctcaataccttccatttgggaacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcttttgtagggacatggatgaaattggaaatcatcattctcagtaaactattgcaagaataaaaaaccaaacactgcatattctcactcataggtgggaattgaacaatgagatcacatggacacaggaaggggaatatcacactctggggactgttgtggggtggggggaggggggagggatatcatcgggagatatacctaatgctacatgacgagttggtgggtgcagcgcaccagcatggcacatgtatacatatgtaactaacctgcacaatgtgcacatgtaccctaaaacttaaagtataataaaaaaaaaaaaaaacaaaggcagcaatctgaaactggttctcaagattgtgctctagatttatacagatagaaaacattttttccatataattccaagttcccaaaagagcccaaaatcattcatatgtcccaagtttagaatgtcaccaaataagccagatgaattgagttcagagacaggctcccattcctgccttgtcatgactataccagcagtgtgccagaaacagttaagggacacctccactgcaacagaggcactgtgatttggcagatgtacctccattcgagaaccctggcctcttaagttagccctgcacagtccaatggaagtgtaatgcaagccacatgtgcaattttatattttctagtagccacattttaaaaatataaaaacaaataggtgaaatccatttcaataacgtattttatttaacccaatataccaaaaacagtgttttcgcaacatgtaatgaatattaaaaatcactgatactttacattcttttttgttgtattaaatcttttaaatcccatgtgtatgtcatacttaaagcggtcaattcagatagcccacagttcaaatactcaatagctacaggtggctactgagtattgagtataccatattggctattaagtataccatactggacagttcagggtaaatgcacttatcctatctgactactcaggagagaccttcttgtgttattacttatgaagatagctcatctctcatgaatttaagtcaaagccaaccatatagagatgaaaaaaaaccaaaataacctggtgtagcttctattcactggtgaaataatatatactgaacaccttctctgtgccaggcactgagccaagggctttacatagctcactccatttaatgctcacagcaaccctaagagaaggtacaactgtaatccccatttacttatgatgaaactgaggcatagaaagttaatttccctaaggtcacacttcaagcaggtggtgatgcttggatttcaactcgagcagtctgactctacactgcacactctacccactgcacatactcaacaagagggagtaaaagaaggatatgaaatgcacggttaagaaatcttagtctgacatgagtgtgcatatcagaaaagaatcaagaaagtatttgaaagcctgcgacagaaatctaggcttgagatacagagataaattcacctacaaggtaaggaagggaagggaatgaaatatgttcaacaggaaaaatagaattaagaactaactaaaattttgtgtcaacaactgatgacgacaatgatgatgatgataagaactaacatatttggagcctttgctctgggtcacgcattgttctaaagtcagtttctcagcctcagcattatgaacgttagggctgagtaatgattgtaggagctgtcctgtgcattgcaggatgttgaacagcaccccgggccccctcactaaatataaggaacagcactctactctcaattagcaaacaatcaaaaatgtctctggccattgtcaaatattcccctgggaagcaaaattgccccctgttgaaaaccctcaatctgagtgtttcatatacattatctcacttattcttgacagcagacgtctggggagacatgattgctttatagatcagaaaactgaaggtgtggttgggcagctgacctgaggtcctgtcgctaataagtgaaagagctagacaaatccaaatttgtctgattctaaagtatatttttactgctagcccccagtacaagttctcgtctcatctccaattcatacagggatttgtgtgctttcccactccctgggctgatgctagagatgaacagaaacaaaacactgctggacactcctcaccgagaagttctcctgccacaatcaccttttgtgtctcctttccaccttgtgtctcttcgctctatttggacccacgttttcttggctaatagcctttcaggaaataggcatggtatgaatgaacagataaatctttaaagcctgaatacatacttatggagaacgagtcctcaaactcaatacaaacatccaaccaactgcaattaaaagccacaaatatgtttttataagaaaattaagctatcaccatatcatctttgatataaagtgagatatgactaaaaatggaggtaaagttcaaattgctacaagttgtaaatttgttcttgaaatatcaaacacatgggaaacagaagctaattattttgtcctatttttgtatgtgaaaattacttataatctgcctgttaaacaattcaaaattattttaaatgataat

SEQ ID NO: 1173 - DNA, 2957 bp, Homo sapiens
agcacccaagaccccagggtaggagagcccaggggaaagtaaaagaaccctaaagagcagtgtggctggggagagaagagccatgtggtccagacaaatctggagggagggggaggactgtatcccacaggacttggatggccacgatgcacagcatctaatttgtggattgaatgggaagggattttcccagagatttctgccctgggatctctattcttttctcaacacattcctttcagagaaccagggcaggaatccaaagtggagaccaccaggctctggtcatgttggggttgattttattttcctaagattgtggcaacacgaactcccatcccacaggcccttctgtgatgtgacctggccacagctcccttgagcctgggctggcctgaactgtaaccaagaggatgtggtggaagagaagctgtgtgacttctgggactagttcagaaaaggtcatgagctttgttttctttttacctagctcacttggaacatttgctttctggatgctcctcttgggagccagctgccattctgggagagagtcaagccatgtggagaggccacatgtagaccctctggtcaatggtcccagctaaagcccagcctccgggtcatcccagcccaggcaccaggcatgtgagaagcctcccagtgattccagccaccaagtgttcagtcacccccacccctttgagcctttccagctgaggtcccagatatcatgaagctgagttaagctgtccacggaacccatgcgtgtactactatggtagtggtcttatatcactcaagtttggggtggtttgttgtgcagtgagaggtaactgggacgcatgttaaaggagccatgataggcaattttgcccagagcagcagggtggcaactgagtcggttacaatcatctgaactatcatcagattggaactcagaggttctgtttaaaggactctaattctctctcgtgatggagtagaaacctgagagatgccaccttcaactcaaaagcccagctctccccttcgacgcagggtcaaggcaagacagggaataaacaggtcactcccacagttctcgtttgccttttcccagatgtgaaagttacacactgactgtgattttctgcccgagtccttatttaattgttattttgggatcagttgcttttgaaagatcccccagctgatacagactgctggtatcctgccaagagagataaacagtctcatcttgcactgcatttggattcagtgtcagcagaatatagcagctgcctcccagcagaactgtctgtggtggaaatacctgggtggtctgattcaaattcacctttcaaatctttaccttgtcaattttggtaacatgcagctgccacattcatgagcacatgatcaggtttctcaaacagtcgaaatccctgacaaccatgctggtgagcaacctatcctgatcacccgaaatactagtgattattcttttcaactaaaatatgtaaacaaaacctgatgctaagcaaatgttcacttttgtgctctttaaaaaatgttatgaattaaattgaaattactcagcacaataataaatacttaccaagtgttattttgcacttcaggtggtaaaactgtaactgtgaataaattgcttatagtaagattttttccccttgaatgctgtagcagcagatgggctaataaatatgcaacactttgtaacatttgcaatttcagaggggtagaggttcctccacctttcacataaacaaaacgtatagtcatccaatattatactttttaatggaaaagcttaagtcatgtaatgtaaataccacttcactttcaacaattttactagttgcgcaacagtaagatgaaagaacacataagatggtatttatattctctctttacaagaacattttcttcctttcttgggaacttttctgagtttgaaaacaagaaggattcttgtaccttcattggaaacgaaggtggggagcatcaataagcagcaatttattatatgattctctttgcttctggatgaatgtgagtggtggttaggagcagattgtggtgacaggcaggtctctgctcctcattagcttgatgacctttggcagatcccattctctttctggtaccaagtttttgcctttgtcaggtggggtgtaagtagtaaccttccccttagggctagtaagaggattaaataatgcaagtaatgcctggcatgtggcatattcaatgaccactgttttcattatatttaaggtgactgagtgagtggcatagggtttaataaaaaatgtttttttatgggaaaggacaaccatggttaaatatatgcccgtgaattctgacagaagaggtaggtgccttaggcgcacattttttgttgttctagcctgtctcacgtggatagaggacaaacattcattcgctggtctctgttcttggggaagtaacatagatacaaatccttcattccaggatgctgaggtttaatccctttgaaaggagggtgctccatgctgtggaggggcctggggaattctcaagttggtttgtgggggtcaagcaggttcttccttttccctgctggggctggctggaggatgggaggcctctaacaccacaaaggtggtgaaggcaaactggaaaatcaccatggggaagagacgtgcaaggtgactaaaatcttgggagcagcagtgttgggaaaagggcttgtggggtgcctgtataaactggccataaaaatatgggacaataagttgtggaaagccacaagaggtctctgaggaggaaagcctcctaatagccctcatgttcccatgcttagagcgagaccctctctcttatctgtaaacactgtgttcaaggagaaaggcactcctttgaagcactggaatgtggacagacgtgtgggctcctatttaagcccgctc

SEQ ID NO: 1174 - DNA, 2285 bp, Homo sapiens
gcatatatcaaaacatcacattgtacttcgtaaatatgtagaattattatctgtcaattaaaagttaaacaagaaaatagattgcaggcagtggtagaagcaggcagatgagttagtaggctgttcaatgagacaataagaaatgatggtggtagtggtcccaggtgataaaggccggggggtggaggagaaaaggcatcgcattctgaatatactgagagtaaaaccagtaggatctcctgaccatttgaaagtgggacatgagataagaggaggaatcaaagcgtctttccaagtttcctatctcagcaatcagatgcatttgccatccgttgaggtaggggtgactatggctggagaaagactatgaatgaagctggtttggtgaattttgaatgtttacatttgaaaaattattttagcctccccaaatgacaaacacatgtaactgggctattcataaaataactacagaatttttttttttaaagtaattcatcatacacggtaagcagtgtggttcagtgataacacaaattgaaaggtgaatgacaaccattttctctgctaggggatgttgggtatccctgcgagtgtgtgtctaactctgcttggagaaaacacggatgcctctgtggtcaagaggtccagctcaaatggctcttttgcctctgccatgacaggccctaagtacagagcttatttgtttattaaatgcaacaacaacagaaaagccttgtcatatcctgttccgtagatgaaaaagctagaggcttttcaggagaaaaaaattacactaatcttagcaaagataattttctgaaactttcctttcgtggatgtggctgtatcccttatcagttgtagtcttcactgtgtatgcagtaggggaaagtgaaggatggaaagagggttaggctgactcccaagattccagaaaacagtttgttctttttattagttgtgaagctgaaagctgaatcctacaacaccacaattcttgatattttcactcctctgaacatgtgagtttaattcaagataagaaatgcttcgagtcctgttaaacttacacactgtctgttgtgttatgaattgtagggcacatttcagaacaagtggagggctgattataaatgatcctttggtgccagcaaaaaaggtggtagctcaggatgctaggttactataaaaacaccaggggaatgggaagagtgaaaggatgccatgtggagaagaaataaatttctgaaataatacctgcatgccacgtctaatgttttcctttcattaaattcataggtaataagaagaatgctgctaatatgcaaaaatatcaataaccttgaaatgtatttaggtatatgtgaaggtaaattctcaagggcttttaaaaaatatagattctttttaagtatgcggtacagcagataaacagaacaaaatatttttcaagctgcaaccacggagctaacaactaagcaggaagaaaggcgccatgattaatgctccatctattaataagcaatttggactttagccatcaatagaaccattgttggtcaatagtgccaccaacagttaagtcatgaggtttgacatcagctaggtctgatagattcctgcatcaccactcaggacaattcctgagcctgtttgtgcctcagtttcttaatttgtaaagtagatgaacacagttgcgaggattaaatgagaaaatatgcacatacagttcagtgcgatgcttgggagtgcagtgagagctcaataaatggttgtgctgacaataaagatgatgaggacaatcatcaagagagtcatttcaactcagtggtaagattacaatttccagggcagaataaagcattcagcagagtcacggtccaaggcctaccctaatgactcgttaggtcaattaaaaaaagaggacaatttctcattgatatagaaactgatggtatttgtcaaattcagctcagtagaaatgccacaggaataacacaaaatgcatttttaaaaactactgagctttgcatagaaacctaagtagtacttgttatgataaagttgtagatattgtttatagaatgtgatcaggtggcagagtgacaacctgaacctcgagtggtccaggatgaatcaagagatgctttcactgacctttatcatttcacgtggatgaaattataactttcagaaagcattataataaatttatagtgcacactattttagaggctgacatgtacagttctttttccagctcagtattgaaaatggaaata

SEQ ID NO: 1175 - DNA, 3557 bp, Homo sapiens
ttctctcgtgacagccatttagatggattggacagagaggacaactgtctaagtcattatcgaggcctgctggcttccaacaaatggcatgaaatgaaaaaaaaaaaacaactgttctacaaagatgtttcctgagcaccttttatgtgttcagtgttgtgctaagtacttttgtattcaaaagtgagtgcattctgagtacttctgaaagttcatgtaatgagttcagggactgagaggtcaagaccttcccagccagagaagatcagagagtaggctcaggtagaaagaggtaataagaaaacactcctctcccttcaatagcacaggctattaaagaccgaaaccaaaccaaaaccaaaccccaaacccaacccaaccctgaagctttgggctatgtgctcaccagggtgagcttcagaagagtttggatggtgggtatggtgcagggctcactcataatagaggtgcaataaaaatggaatgtttgttgaaggtgtaaataaaagcccatgatcttaagtgtcactgcctagaggaagggaggatggtggtggtggttgtggggttccatcttactcagccaaaatcagaccaagctggtgcctgaacattgtcaggacattgacaaactggagttaagtccaagggagtggtgcctacatggtgaagtgggggtttaaaactgtaccacagccactcctctgcccacttttctcctaaccatccaaaaacacatttagtgtgatccttccatgagccggacactgagttaggtgttcaggacatgatgacaagaaacaatccctattctaatggactatgcagagaaacaggtgaaatgtgaaatctgctgattcttgtgagttgagtgcagtgctagcagtctttaaaagtggagttcaactgaggaatgattacatctgccttggttgctaatacctcattggtagagcccttgatggtttagaaagctctttctcatgtagtagttcatttggccctcatgaccctgtggaatacgcaggaattatcatgcccattttatagatgaggaaaccagggttcacaaagttgaacagctcatctgaggtttgttggtgagttagaggcagagctggggacactctcagtttccagagtaagagttcagtgttctttctaccagtcagagtactttgtaccagtctattcagtcggaccttgattatgctaaaggagtggtgtaacatgtttaattcggagctattacattgaaggaatttagacatagaaaagactaataaaaaatttaaaagtgtcctacattttaataagtcaggtttggaaacaaagaaatctgatttctcatagttcaaaaatattgttaaagatgagagagtccctgggggagggcagaggcaaacagttcaataagtccaaaggaaatgggcttgttaactccagaaaagagaaagcttgatgaggtgacagcagcccttctggattcaagcatatgaagggtggcataggagtgagaagttaagaaaatctggggttccaggaggaagccataggatcaacaggtggaagctaagaggagccatttttttggggaggcttagcacaaggaagaattttctaagcattagagctgaccagcaaatgaaacatgtactctggaaagggtgaagcagagagtggggcaacgatttgtgcagaattttgtagatgaactgtgcttagaacaggggaccagatccaatgatccctgtagtgcttttgatgagcttctgtgactctgggctgcagcagtttatatctttgaagtatgaaaggactttgctaacaaccacattaataatggtagctgacctgaccaccctgcacagtttctaattaagaacaggaactcagagaaggaaggctgcgtttcctttatcttcttctgttgtcttcagagtccccagggccctgcctctatccttgagagtattcctcaaatggtcattccatattgaaaatgaccccctttagatcactttttcacatcaaaggagagtatgtacatcctctactttcagatattcaatccattatgcctttaaagtttggactacttgagagaaatgaataaagttagtttatcaattagtatctgctatgtgattgagctgggcatagtctagttgtgaatgtgacacaaacacatgaagcaaaagcagctactaaagattaatgaggagttaaactggaaggctctactgctgagtggctaagagcactcaagggctctagaatccaatacactgggggcgaatggaagctgggctgcttactgcctaaagctggctacagatcatttcacctcatcggaccttggtttccttgtttacaaaatgggaataacaatgcctatttggtagggttttgaggaagattaaattagacactggtaatatgcataacacagcacacatagtagttgtttaataaatgatagttactattagggatgataatataataaatcatgaactataggctataactttcttagtaactcaggatggaagtactgatgtcgcttaaagtgtgaagaaaaggcttcatagaggcaggaaggatgatgtttagacaatggagtcagacaaactcaggtccaaatcccatttctaccatatcacagctgtgggatattgggaaattcactgctctgagccccagcttcctcatatgtaaagtacagataataaaagtacctgtcattgttcctatgaggactaaataacactcagcacatgtacacagtaagtactcagtaaatgttatcaccatcatcatggaaaacaggatatgtgagccagacacaaaaagggttatgtacgtttataccttattccctacctgaaaactcaatctgtttgattttttttacaaccccaaaacatagtggatttgaaagaaacagaaagacccccaattagttttatatagaacattaggataaattcatctttaaataaaaaaacagttcttataccaaaaattgtgtatgtttccaaaagtaaaactaattttttccatcaggtgtaatgtttaaatcacatatccctgaggtaaatgattataagtgaaactctcagggacctgccattggattctgtcttactccatcagcacatcatggggaactcagacctctggcacgtaagagttatatgctatataattattcagtgtattctgtgcctatgtttgcaaaaaagatacatttttaagctggtgctattaaatgagaaaacaaaatatatttacaaccagttgggaatctttcaagatgaaaacaaccattgtaatggccatgggtctttatcacccatttgcaaagggatcgaggtagatccaattcattagtagaggttttgctacataatgcatacaaactggagcaataactgcgatataaatgcattcattccaatacatatcactatagaatgggaccctcgcgcattataaccatggggactaagataggttttttggtttttttagtaccaaagcttcaaatggat

SEQ ID NO: 1176 - DNA, 2531 bp, Homo sapiens
atttcagaatttctaccaagaatatagactattctcattgtttatttaccccaagttgagagaacgttagaagagaggaaatctagaaaacatgctgaattctggtaaagttcttcactgtatatgtaaaatataacttgaatcataatcatgtctgggattcaagccctggacatgccaaagtagtatatttatttgcgtttgggctagatacaaatgtttagatggtaaatgcagtattttactccgagtttcattgtacctacttaagtaaagccattattggtgaattgggagaagagaatactaaacaacccaagccttacattaggttttgaatattaagatattagaataaaaactatttcaatgcttcataggaattttattctgaaaatccttggcaaggcaagtccatcactgtcaaattaactacaagtgtgctattaaaatctctattttacttatataaaaatataaacctcttaaaaacttttactttctgataaatatttgtaataatacaaaataaaataagtaattcatcttatttcttgcagagactctcagagtactcaattgaaatttgaactacttttatctagtatctgtgacaaaatatagttgttttatttataaatactccatgagttcaactacaaaactaaaaactgacaatgaaaatataaagacaaatcagtggcatctttgaagcatttcactggaaatggctgttagaagataaattcttgttgtaagtgatttaaatgcttgaagaaaaagtacatgtggtgttggtatgctaaaaatgtaattaaaatgtatattacaaatgctagtttagagaagaactgattttaaaagccaatgatgtttcctgtaagggcactgctgtggtattttataatagatggtacctttttctaatttgaaagctacatattttaatagagaatggcccaaaatgtttttaaggtcaaactggaaatatgttgatgatttacaaaaatgtaagccaagtgctttattatattatactaccagagtgttattgtagtttaaaaatatcattaaatcagcacaaacctgcacttatcatttcctacacatttttcacaccaagctgccttctgactatgagtaatctgttaatctactcttcgcctcacaatccgtcaaagtgacagattcattcctttcctaatacataatatcttcatttactgtatgccttgctgcaactttcttttttgctagcactgaaatttagaaattcacaagcaaatttagagaatgtcacatggctggttgtttttgtttgcttccatttcttctgttattccagcaaaagaaactaaaatttttctggacttttaatgtgaattagtagtatttccaaaatgaaggcagtttcaggtttcaataggagtgttgttgaaaaggttggaagagggcagatggcaaaaaaaacaaagtgcatccttcaccaagttaaaacactgatcataatgtaattttctttcaatgttagtggccaatgtatagattctcaccccctaccctcaacccttactaaggtgtcaaggaaaagatattcttttggtagtttagagatgagctgcccctcaacaaaaaatgtagtttcattaccataaatgtcactgtttaattgaaagcaatactgtgattttacttaagctgagactttcattttatcgtagtattgagatcagaccaggccagatctcaggtttcttgttcactgctattttgataatacaaatggttccactgctttaaaattgttcactactaattcaacagaaaatattttactcttcttttcttgcaacagattacagttgctttttagtttattagttctgcaaataaagagaatcaaagactgaaaaatatgagagtatgtacaattctaactcacttactttcatcataaataagcgataacaaagtacattatctacaaatcgccatttggtctcgcttgttactgagccagtgtccacacagtaattcaaaggtcactactgttgttagcctcaaaagtcaaaagcaaataagttgtttacctcaaaatgtgggaagctgccttctaaccagtcttgtttcagaatatagtttttttttcccatgcctacaccaaacatccaacagcattttcttgtcctgagcaccaaattgcatctgatttgtcttaatggatggcaaaggacctaaaggcttttaaaaatcaatggacaagaaagagtcaacagaacaataatgatagtgttaattcagtcaaatacactaaaagatgtttgcctttttgccttcaagtcatcttaaacagcctggactgttgacttctatggtatttattatactgagcgggtttttatatggtaatgaacagcataatatgaagctgtgaatgctggtaaacaatgcattgctagagtgaaaaattatgtgttttaactttaatcaatttcaaaatgtaatgtttttcattaacaacagaaacaaaa

SEQ ID NO: 1177 - DNA, 1911 bp, Homo sapiens
tgttaggattacaggtatgaggtaccagtttttcttagtgtttaatgtattacttgcgttttgtattgttgctactttaaaaaatgccacctagtattctgaaatctatcagaaagtgtgatacagtgaaaagatcatgtattttggattctgggtaagcaatttcctagctgtgcattttgggcaagatacttaacctctctgagcctcagttttcttatgtgtagaattcagatgatatctacttcacaggatttttgtaaggattacatcactgtacttttcttacttcctaggttgctggagggcagagaaagtgtcttactcctttatgctattgacatctaccacagtgcttaagcacccagtaggcatacagattgacctcagtttattgtcagacttttgcatcttgtcagatattttcccattgtttctatacttgcacacccctctcaacttacctttcatgcaacattctattaatagagtattaaaagtctattaagtcttaataagtcttatcaattaaaagtcttaagcatctattatcactgtcttaaaagtcctagcttattgtattgtctgtttaacttctgacagacctctaagttaattttacaaaatatttcctgagcatgacctctttgaaataaatctcccccacctgtccatggctattccccatagacccacttccagtcgcccattttatattatttcccgatcacaacactctaactccacaaagccggcttgctattttttgatgctctttttcagctttcacttgctatggacaccacttcaggtttgttgcccttggatgcaggtgtttctgagataggcagggtgttttataatatatgaatactttcactgcctgcattctgaagatttggagatgcaggttatctgctcttgaaaccttctttgcttttttcatggttctaagtttcatcgctgtttcaataagcattaactcttgattgctctctttggctgcatttttcagctttaaatgtgttttttttttctactgcccttataagccagggagcagaggctttcatgtcttcaggaagtctctcttcctccttcttctctgattacatcctgctgatatccttatgaagtctggatcttttgtcagatgaactttgcttcctaccattgcaccgtgatacatttttatgctagcattatagtgtctgatatctgcttggcttggacttgctggcagtaatctttataggtgagatgatttattgtggaaaattgaatcccaaaagtgtcttaagaaactgtttttttcttttggtgtagattttaggagagaccttctttcctgctttcattgatttcctgtggctgagtgatatttgcaaagagttccagcctaatatctctttttgtaaatcagcagtcaattctttgagactatttttagctctagaatgtttaataagcctttctctttatatatgatcaatatggtggttctaaactggtgcgcctggacttcttacaggaatgtcctcaaactttggtcaatgtttaaaatttaattttgctaacattgagtcatacagttttgctgttagggtgttgtttgtcacatgaattgttgacctgaacagatcgtataatgcactatactttggggtgctgcttgtggcaaacgtgcatttcaaagtatagcataatgtcaatttagtgtcaaagaaagggtttccatttactggaacgttgattcttaccttccttaattctaagggattgtggtcaaggcagaaaacagttctcagagagagttgtgtaaggtggctaagggtagtaggatggccatagacactcctataggggtgtgaaacatgattattttttgtgatacttcatgttttgtaagta

SEQ ID NO: 1178 - DNA, 2542 bp, Homo sapiens
ctgttttcattgctatttttattgcattatcttatatatatcttattgtaagctgccttagatatcttttgaaaataggcagggaataattttcaaataaaataaacatatcaaagaaaatattcagcatgtgtatcattgcctgagtaagtggccctgtgagtacattttgattgaaagtaaaagttttgtcattggctttgagtcccaaggcaagtataccaatattttttgagaactaagaaaagcagtttcagagtaaatccattgttatctgtttccattgtactggatttgccaacaaaattacacaaattatatagaatgacaacggatataaatccaaagaattggaggctatatttttcttgaaggtctgccacaaaaaaattggaggcagtaactgtggttcggccaacttgataattggttggaacttggatattgattgagtctagttcctgcagagattttcccctcttgcagagtaagaaaagtaggtcaaagcagatagcatggctggaatgcataacaagttgctaagaagctaaaatgattttgcgaagaccatgctaagaaacagcttttgccagttcttgaatgcgtggtatgtctgtttttgtatcatcatctttattatctttaatcctaaggatagagacacacacctgcaataatctccagctctttcagtctttgttgtgaagctcgcagttttcccttccttatggagggattttcaccttttcttcttttctggacaagagccaattttttccctgctgcttcaaacctcaggaagcacttttatgaggctttggacccgaagtacactttctgggattctctgagacggcggcctacactagaggagcaagtcttccgtcaggacccctgaaaacatgggtcactagaatcactgcaggaagttagtatgtggacatggtggagccgtgacctttgaccctattctctcaatctctgcaccactgaccaacagggatctgcaaacattttgacagctcctgccagtctagggtctgcttagaggatgatacagatctcattccagggaggagctttccaacagtttgtagaactgcctctggtaatttgagaaacagccccttcattctagcatgagccagtcactagcaggagcttcttagtctccgaacaaatacttgtgacatagagcaaacaaagacttgtttgctgtgccacagggcgcttggatcttgccagagcatcactttcaggcctggaaattcccctttcttctccagcctgattgcttttaaaaagctttacattggatcaaccagagttttttgtttcattcataggaagactcttttattctccctgaagcagtttcatggaggctcctgagtgctctggaaaagccatttcttatttcaatatggcagagggaggtgcctcaataagactcttgatggggtttcaagttaaaaaattggaaacaatcttagcttggggtgctatcacaaaatttaatagactgggtgatttataaagaacagaaatttctctcagttctggaggctagaagtccaagattagggtgcagcatggtcaggttctcgtgagggctctcttctgggttgcagactgctggcttttcattgtcttctcaatggatgaaagacagcaagctagctctctctggcttctccctataaaggcactaaccccatcataaggactcttctcttatcacctaatcacctaccaaaggcctcaatctttaaataccatcacattggggatttgatttcatacatttgattcaacatatgaatttggcagagacacagacatttggttcataacaaactttaataaacaatggggtaataattttatgttatgattaaatatcagtagtataatattatgtcaacaaaacacaatagaaaacaataatagagcacactctttattttttccaagtctggaagaaaaaaataaaaatgaatttagcacttactatgtgccaggtatgataagtgctttgcatacatctcatttaatgcttgaagggaaacctatgagaaaggtattattatggtctttgttctacagccaggaaaccaaggcttaaagagattaagcattttgctgagaatcactatcagttagcttctgctaacaaaacatggtggtttaaaacaaacagttattatttcccatgtttttgtgagttggctgcaattcttctggactgggatagcatggctagggttggggctgcatggtcaaggatggcctttaccaggatgataagacagctgggccatgctccattggccactccctctccagggggtcagcccaggcttgtttccatggtggtgggaggaatttccagacacaagagagggcaaatccagatactcaaacacttttcaagctgctgcatcatattggctaatgtcacgttggtcaaagtcatattgagcccaaacccaattcacggggtggaaaagtggattttgtctcttgactgggggtttgtcat

SEQ ID NO: 1179 - DNA, 2978 bp, Homo sapiens
aaagggaggattcacatcccaggcaggacagagcaggatttcatcacactcagagagcatgcaatttaaaattgatgaattgtttatttctggagttctccattgaatatcttctgacttccaattgactttgggtaactggaaccatgaaagcaaaattgtgcataaggagtattactgtgtttggtctttccatgttaaattaagtatttagatcaaacatagggattggaaatgtgaattctggagccaggcagcctgggttcaagtcccagctccaccagtggcaagctagaaatccttgtgtaagctgctgggactgtctgtgcctcagttttctcacctgtaaaataaggatagtaattgtatcttcttcagagagttgttgtaaggattaaatgccttaatccatgaaaacacatgtgacaatgcctggcatatggtaagtgctcaacatgggtcagcttctgtatggtctacacattaatgcatttggctcagaagcagtctcctagagtcctcttcctaggtgctaagagccttccattgtgtgtgaggctttctctgtgttgaaatgtgtgtttaaaataaggacttgggccgggcgcggtggctcacgcctgtaatcccagcactttgggaggccgaggtgggcggatcacgaggtcaagagatcgagaccatcctgactaacacggtgaaaccccgtctctattaaaaatacaaaaaattagccgggcgtggtggcgggcgcctgtagtcccagctactcgggagtctgaggcaggagaatggcgtgaacccaggaggcggagcttgcagtgagccgagatcgcgccactgcactccagggtgacagagcgagactccgtctgaaaaaaaataaaaaataaaattaaataaaataaggacttgacaagagctgctcactgcccaggagaggtggaacctggcgcagtaagccctggggttggacagcatctctgttcacccagctcagtgggggtggcccctgcctcaattcctggtgggctgcattgtctcacacatggtggaggccctggggagaggaagggacatagccaaggagacctggagcctgtggcggcctaagcctccagcagaggccagaaggcaacaggctttgatgtgctgccaggctaagaatggggcaaaatgccaaggaacagagtgattggcacctcaggcctgctgtctctgaattatcatctgcttctagagttgcaaaggcaggtgttgtcctgagagacaggcagggacagatgccacacatgcaggagcatggcagacggattcaagctgtgaccctccagagaccacagtgatggctgggtcctccatgcccccttggatctcaaaccaccgggcaggtgactgtcagccttcctgcacctttaccacccccgtagttacgggtctgtgggcagcttctcccgagcagttctccgagtggccagcagatggcggaatttctcttgtgttccagacagaggctttcaattggcgtagcatttccactgctgagaaccagggagaattaagtactggtaacattttgaaaataaaatgtagcaggcaaaataccttggagaccacaaattgggagagccttttaatttttttaatttttcagaaaaaagatgaaatatacattagaatttacaaaacacttttatattcatcatctcaccgtaaaaagggaaaagatgaaaatcagttttaacccccttttggaaaacaggtaggctgcagctgagtcttccatctgcatgattgttagactgtaaattggatcactcggtgctagtatgtgacaatattattattgctgtaatgatattgataatgagaatatcagaaataatagctgctatttattaaatgccactatgggctaagcattttacatgcattatcttgtttaatccatagaataacaacacgatgcagggatacacagtgatttactgttgaatcttgagactatagcagcagcctcgtgcttattgtcccagaagtaactcagcatcaccagacaaaagccaccaagagttaactcacagcgggattcgtcctctcaaataaaaacatgccaacctgtcccttttgcttagaatttaattctgctactattttcctctgtcctgcttagcagaacatactacatattacattaataataacagcaacaataataacaactatcatttattcaatgcctagtatgtgccaggtgctattctaagaaaatcttaaaacctcacagcagcattactgggtaggaacttttaatcaccactttactgatgagggaaataaagcccagagaggtctggcagtacttctaaagtcacacagctagcaaacagcagttaactccaggggtgggaatctgtcactaagttaatggccctcgtgtcttaattgtctgaatgaatttcctactgtatattccttggtttcatcccagcgtcatcattagtctgacgttctgcttgtaagagcattttcttgatgttccattctttgcctccatgggattttttttttttatggtgagttttgcctctgagcttgtgtccatgctaattccaaaccaaaaatacagtcccagttggtgagtccagattggtggtagggacacactccatatcccaagataaccctgtatttctaaattattggagggatttgactgtttggcagagcaaatgggcatgcaagatgttcatctcagcagagttattttacgtcttttttgagtgtgtctcttttctctggctcagaagaaagggcactgtaggatgactataactaacagtaatttattatatattttagatagctagaagagaggcttttgaatatccccaacagaaagaaatgattgatgtttgagttgatgtatgtgaattatcttgatttgacctctatacatcgtacatattgtaacttca

SEQ ID NO: 1180 - DNA, 2419 bp, Homo sapiens
ggagggtggaatagaggttaatttgctcacatgacaagaagccttgtgactttatttaggataggtctaggcagtgaggctggtaaacatttaacaatatactcatttaaaaaaaaaaagggcagggggtaggagggggctgacttgcagccaatttcaagctaccaacacgctgtcaaccagctcacagaattcctgaacatttaacaataggctattgtatgctgggatgagccatccccagcatgatactagatccagctatcaaacaatatcataaacaccccatcctctcttctctttttcctgctttacttcatctgatttcattctcaaacagatttactcaaagatgactgcagaggaatgttctcagagggctctaaataggttggctttggatctgccctcttaaaactaaacattaccacagaggaatgaagtattctgatcacccagtttgggagctagagagaatgggggtagctacgttcaaaccatttggatgaggcaggactcgcctgaaatggggtaagtgtagccctcctaagaaagaagcactgtgcggatgaacatcatgaacaccatccaagtttcaacatgtctgagattaaatctgcagcaaaagtttactccatttctgggtgtgtaaagcagctaaaacttcctaccatgcgtccgctatccatggaaatccggaacaaaagcttaagatccaagaaaataaaatgtgttttgaagaaaaatatgctcttgcaacataaagaagctgtcttcagttacaaatagatataaaatgtgaagatatataattgctgcataaatttattaatagaagtgctaatgccataaatcgtacatctccattttgacacgcaatcctttattttcctttcactgaggaagaaaaataaaggagcggaactggtaatattgcttgcaactaaattggattttccaccagagaaagctgtttagaaaaagctattctaaaaaagcaaaatagtactcacaaaagggtattaatgaatccaaccaggaggaaaaagcctccaacaatacaaagctttccaaaacctctttcaggactgaaagccaaaaggatgctttgaactctctgtctttgcagaaaccatctcacctacaaaccgagtatgagatagagttcaaattttagaataagaactcttaattcaaactacaagtcttaactgacgattcaagaggagagactgcagcagctctgggtttcgaaggaaaccgatacatcctgccctcaaactgtgaggcactataggagcaagatgtaaaggatgcagtgcctttgcgctcccacctccgccaccgtgggtgtcataatacagaggtgaaagttcaacatgcgacaggtagggatgcagcagactctgtggctttatactgcataggtctttcactgcttggtcacagaatttctttgaatcctatttgtttatacactgatatttatgtaataacaaaagagtaagtaaagagcaaggaaacagccaagaaaccctgagcaaatttttttccccctaagaataaaggagttgagttaggctatcttcccggagcttctctttatcgctagatgcagtcagctggaaacatatgcctgctaattgctgaatgtgtgcctcatggagcaacggtgcagttgtcgaacgacctcggggaaacaagtctaggcctatttgtgcatttctttctttcaccatgggactcaagtgcttcgccaggccactattaggacagtggaaaatcaaggtggaaggctctgatgaaatcaattatcactaagttattttcactggtgaaggggtttcctcacaggggtttaatagtaaattattctttccatgggatgtgctagattaatggaggaaacaaagcaaacaaatgttgcctggtaagactaagaggagggtcccaaaatactaatatttactgcccatgaagagatagccacattcacaagaaaataaatgtaaacctacaattccagaggcgaaaaggaaaaagaaatgctaaatggcagttatttcctcagtgttatacattacacatatcaataaaccctagagtcccatactatacatgccatatggatagataaatggcatatgtggtaatagtctttcaaactggatgatagtactttgcacaagtcagggatgcagcaattgtttgaaaatagggaaaataaccattttctagcattacctagtgaaatgtaagtgtgggtacagtttgggagaatctgtatagtatttatttttatcctagcaaactatactttacctttctggtagaattttaactttggatattttacaaatatcatatatagtcttggtaacatcttttatttaaaatcacaaatattagttggatagat

SEQ ID NO: 1181 - DNA, 2122 bp, Homo sapiens
atttttagtagagatggggtttcaccatgttagccaggctggtctcgaactcctgacctcaggcaatctgcccgcctcagcctcccaaagtgctgggattacaggcgtgagccacagcgcccagctgagatactatttttacagtgaagatattgatggggagaaagctaaggcgcctttctaaactcacatccctaacaagcgggtgagcaggatttgaaccagaccctctcgctctttcaccatcttactaaagagcttatagttcataaccactggagtattccacttctcgtatacaagaacagctggaaggacagactttgctagttttttatcagagagtaaatctgaaatccacctgcagacctatgtctagtggtaacttgctttgttgatatctgacttactgtagttcagcttctctctagtagccccgtatgttttctgcttgttttttgtttgtttatacttgaagatctgctctgaagattttctcagacctctggtaactgtgagttacatgggaggctgcttagaattcttaaatgtcagtagtagctacctagtgtgctgctgctttatttcatgcataagcaaaaggagaagtaacctgtataaaaacttgtgtgccatgataggatattgctcttgctttctatcttatctcacttttttcttctttgtattcatctaggatgactgggaggggctcagggaaataaatgtcgttgcatggctgctttgtgccaagcatattgttaagtgatttgcatacctggtatcatttacccctggcagcaactctatcaggaagctagcagtttttattgctatttcataaataaagatgctgaagcttagagtggccagtggtagagacaggatttaaactcatatctgcctagtgtcctatctagtacattttctcctctgcagggctgcctcagactcaggttttttgtgagctgcctgctaattaggtggttagtggctgctgctttctcatgtttagttttgtttattattaaaagaaatctggctgggcacagtgcttcacacctgtaactgcagcactttgggaggccgaggtgggtggatctcttgagctcaggagttcaagaccagcccgggcaacatggcgaaaccctgtctctactaaaaatacaaaaaaaaaaaaaaaaaatcagttgggcatggtgatgtgcacctgtaatcccagctacgtgggaggctgaggagggagaaccacttcagcctgggaggtggaggttgcagtgacctgactgtcacactccagactgggcaacagaacgagaccgtctcaaaaattaaaattaaaaataaaaataaaagaaatcttattgtttcattttactgtcttgattggctttaaccctgtttccaatgcagtcttagagatggaatacattataatggggataaccatgtctcagtgtcatctctcatttgatctaatcagagaatacgaggttatatattgacaagattgtagggacccagatgagggggctgcattgttttactgtgcaaaagtagtttatccgttttttattgtgagtgcttattgagaacctcattgctctgtgatcttaatcattactaagcaagttgaaagatacagtggctgtttattaggttaagggaagcccacacatctatccaataaatatctgtaaagcacctgttacatgctgtgcactgttacaggcactggggatataggaatgaatacagcagaacatgttcctcatttgccctaaaaacataaccagtgtttggaaattctagaatggacctctcattattttcatttttatttcattttaggctattttatttcctaaagtcactggtgactggccatctttaacccttgaaaatattactacaagtgaagatctcttgatagcaaaactgatgactttaggtcttccctgcctgctgttgaataactcttttaagtttgttatgaaatctgtaacatgacttcagtatcatctagtcaagctcctacatttacctggtgaggaaattgagatccagggatgaagttcaaatagcaaggcaactccattcaaagtaggaattgtgacatgct

SEQ ID NO: 1182 - DNA, 2184 bp, Homo sapiens
tcttcctctcttcataaataacttcagatttcctagcccactgctctagaaaatgtatttcctctgatggccacacagccggagcaaccccagaaggcctgtggtgttgtgctgctctttattttctgccagctgcatctgtactcttctagaaaatgctgagattcagcagttgctcaaaaggcactgacatctaattatcatcctataggctgttgccacaagtctgcatagtgaagtcaatgctgagacaggcttcctttgccagtcagaggggctctggcttgtttacagatagaatctttaactcctttgaagggccagcgtgaggatactgggaaggttcctgtgggacagttttataattgaaccagggaactcctctgtgcctgctcatatgtgatatggataagtcatgcagcaccggtcctcctgcatccaggaatgggctgacattgatctgttcactcttcagggatgctgtctcaactacttgcacaggtataattttattatattacgctgcatattaaatacctgcacttcccttttcccatcctgatacagatgatttcattttgcccacagtaacacatgcttctgtttgcacgtgaccatgatcattttctctacctctaggcttacagaagggccagaggtggtgctaatcaggaactggaaacttctgaccccactgtgcaggctggagtagggttgaggctgtggctgagaaccagaaggagaaagcaagggcaagtccccattctagaatacctggctaggatgtgggggagagaggtgagcatagctcctttctgtaaaaattacacttacacagagcttccctggctttggaactgtttgctcttttttttttttttttttttttttttttttttttttgagacggagtcttggtctgtcaccaggctggagtgcagtggtacggtatcagctcactgcaactttgcctccctagttcaagcgattctcctgcctccgcctctggagtagctgggactacaggcatgtgccaccacgcccagctaatttttgtatttttagtagagatggcatttcaccatgttggccaggatggtctcgatctcttgaactcgtgatccatccgccttggcctgccaaagtgctgggattacaggcatgtgacaccgcacccggccaaagtggttgcttttattctaacaacgtctgtgtttgcaacggaagagagaccacaggagtgctagagcctgagttcagggaagggtttgacaggagtttcaaggcttcttgttggcggggtagaacatcatccttccagccaggagtagctcttcatcagattgcccgggattggaaagggatcagtaccagatggcctcctggccccagaagttccttctggagcagaacagagttttcttgtcgctatgattcagcaacagcaggcattgatggcggccccactgggtgcctggcatggcatcataccccctgcctcccagaacctgcggccctcctccatggccaaggagcaattgcatgtggagccataccagcagcccccattgagctgacttggttgcctgaagtgagaatggttaaatgggtaattgatggaagcaaaaagccaagggaaggaggtacccgctgggtaactggttagtgtaagaggctatgtgtgtgtagctgaagttgatcaccattccaaggcgagtcttttcccctctcttctttccctcctttttatttaacaataataataactttattgattcattgctttttttgaggcatgcattaagcccttcacatttattaacttgaaaaaataggggagttgagggcccagaaaggtaaaatgaagtacccaaagtcacacattttagtgagtggcaaaaatgggatctcagggcatggttcctatctcttgacaatctaagctcttcaccctgtacctcttttccatctctgcagccctctctccctctcttctttatagatactctgagcgtttatcttgcatccagttagcaatgcagtttcagagatagaggacataggacgtcccttacggaactcaaaattgagtttgcagagacaaccttaacctttgtaaggtgagggaagcctagagtctcatgtggtgtgtggggcccagggatgcgtttgtaaagcttgggt

SEQ ID NO: 1183 - DNA, 1948 bp, Homo sapiens
tttaagttggtagaagaaagagtacccaatacttacaatgaccttatctttaagtagtcctgttcttttgaggccaagaatcttttatcgtcaccctcagaattgggttctggtgtttctcccttggcttccgtctgtttcttcaccattaaatgctttcatctactttctcactaggaccaaagtgtcttttaaccatgcaaccttcttaatggatttcagtcagatgcacatagaagtttggtattcctgttctttatctttggttaattgtgttttttcatgaagtatattgttattgaatttattatcttaaggggaacatctcattcatttcattacccagttgccattgtcatatgaatgcttgaaatttcatttatatttcattaattccattgaactttggaatcataaatgcatgattcttcaagagcatctacattaagaaacgtttcttatgtgacattgtttccagcctcctttatggctgtggtcagttctgaatctttgcatcagaaacaaagatataaaatgattgtcatgtctgtatccagagatctagtcaataggtatatttctgaatacatttaagaagtaattgaattgcatctgatttattcatcattcttaaactatttctttttgacaaactgtcgtcaccaactctactgcagtttcctcatttaatgttctccttctactgggagagttgagctgccttcctttgtaccagttttcatttttatttaaattctacccagaatatgactgtagtcctttggtttttccctcaggtctgtagagtcatttgcccccttttcatttctgcccttctttcatagttgaaaggaaacttcagaactcaaatgctttgcaagttgcgaacccattctttatatcatgtcggtgttacagactgcttaattatttttctccatctggagaggcttagtaattaaatgaattgcagcacctgggattatttatagacattgagaaggcaggaggagttcttgatgactcatccatccagggctggcgaggaagcctttctctccacttccctgcatttcaccttccccctccttccccaccataggtagatatgatctgtccttcctttgacccactctgacttatagcattccatcttgtattaaagctgttattttacttgctttcttctgcattaatactgtgagatcattgaggcttgagagtcttcattcatcattatgtctcttacacacggctaaaactgtggcttgattgtgtaaatacttagctgaatttcatggaaacacatttaggctccattgtctagattggaaagggacagcctaatagcttattagctacaaattataaaaaataggcattagggggtagagcctgagactactagagtataaactctctgaagttgaagtctgtgtcttgttcctcttctttttgtataccaccaacccacctttccctagccctcacagtagtgcattgacctcaattattgctcaggaaatatatactaagtaaaactgagttaaaggaaacctctgtgttttatcacattattaattatttgggtttttgaaaagcatatatctagatggctgtgtaagcgtcacccaaaaaggttgctgtttgtgtcagaagtgtaagattcttgagctggtcaaggacattgaacatgaagactgtgtaacgattcattgaggttggtacctctctttcctggggctccattggatcaaacatgttaaagggatgcatctccattctatagtgcgttcagaggccttaaaggactgttttactgtaaagagtatctgggtgtatctttataaggtttcccaataaaatgcgtttatctcactaggtgatgagtgaagagggttttttggatcattttgctaattttctttcccattgtctctgcctcttt

SEQ ID NO: 1184 - DNA, 1874 bp, Homo sapiens
tgccttaggaaggatgatactgtagtaaaccaaaacgactgtccccattgccctgcagctcagactccccaggcatagggcttgagtggtcttggcattcttctgaacagtgattctcacctcatagtaactctgcacagcgttcatgaaggcttcgtcagccatgatctgggtttccccattgaggaaagcctgaaaccggtccttgactgtctgcagctgctgtttgctgatctgtaagaaacagaaaaagagggaaatgtgagaacttgtcctagacaaggatcatggatactttatgctgaagatgccagacccattggtgtattggagctggcttgtataggtgtgtgacagctgattagtgaatctgtggaaacttctgtgagccagtgttaaacacagccattattttaaaataatatataaataaattatattaaaaacaaagttaatacacttttaatacttaaaattcattgcctcctagttattttaccacatttcactttcatcagtgcttttgaggttacttacacctatggtatttgcatgagggaaattctatataagggagtgctaccacccatctcttcccagctccacattcagtgttgtctcagtggcagcttcatgtcagccaaggtgggaatatttagaccatggaaattggcaaatgctacaaaacagtttttttttcccctcctgagaaatggttgttaaacatgtaacagcaaacacagcactgcacatgcccctctggtggtctgaaataccttgatgaatgcagtatgaccatatgcaggggttttcaaactttattgttgttggtacatccatgatcacatgacagatgatgtttgggtacaggatatacttctgggatgtggcatagagaatttgggtactaggttatgtacaattccttgcctatcaatcccacctttctttcttaggaaaactttcctaaaagattcctactcattcttcctcctcaccccttatctggctctatcatgccatccatcaggtatcaatgcaggcagcactaatttatgaagtccttcccagcccctaggttaggggcaggtcttcctgctatgtgattccacagcacagtgtttgtttaactgcttgatgatgattaaatttgttacatgcggtgtcttttcttgctatcttattcatcgaagttttcccagggcatagctaactgccttatatgtgccagacactcagggctgattacatgaatgaatgaatggagtgtatgcaagacatgttattttcaggtatcttttcattggttctaatttatataaaatatgtatattaacaagtcagccaaaactttgctgttttaaaagttaaaaacttttaacttaaaaaagttaaatttttgtgaaaagttaaactttttgtaaaaagttatgctttataatagatcatgagaaactacctctgtgaaccactgttctagtggaaaaagtaagaccagtccagtagcagttctgttggccactgtgtcatctggaaaaagcgacttatattctgcattgacctgagagtgaagagccagcctttctggatcagggctgggtttaaataaattttatctcgtccttagttttctcacttggaaaatggtggtaattctaattacccattgtcctgggatagttatagctattcaataacataacgagttcttttaaaaaattaaaagtttttatataaatccaagtgattttactgttagagtcaatataattagaaaataaagtttaaagctttaggagacacaaagccagcatgagttttgactcagtcaagaaacaaaaacaaaacagaattttgtttgtgacacagatgga

SEQ ID NO: 1185 - DNA, 4843 bp, Homo sapiens
tgcatatctgaaaaatgcatatttttagtttttcttggtgtgtatatagtcaaagtctgaatgaaaataagcaagaccaaaaaaattgtttctttaaggtgaagggattgtaactcccccaaccccacctagtcctcattttattctctataattctgctaatttattttatgataacttttttaaggccagcagacttacatgaagatcggcatttgccttttttgcccactgctcttctaggatcacgcgtcacacagtagaatgaaatcccacattatggacttatccaggctcattaacaaccaggtgtacaaggaacctgcctggttttagccaattcaacctcatataagaagaacaaaacaaaacattgctccagataattatcttttgaagaaacacccaaagcagttcaaacacaccctggagctaaggcaaagtagccagtagagccatactccatgcaagtccaaatctttgggtctacatttattccaggatgcagatctggcagctagaaccccaggaaacactcagtgccttgatggtcatggtggttagctgtgcacatggagacctttccctgtatattgcggcatgtggacctgcacattaagcccactttgccagtcatgtggaatcagcatccaccagacaatgaagtcaattaactgttcatcagtgagtcaattgtcaaattatttgtctccttctttttctcactgcagacagacatcccaggcatgccatccttgcatatgacaccaagaaaacaccaccagatatccagaggatccaagagagaatccttttttgcatatttgaaagcaacaatgtgccccattcacctccaaagttaatttttctaatgatttggcctataagtcaaccttctccccactcatctcaaagtgactacatttcagacaaacttttcagctcatctttggagaatgtatctctccagttcaaacatgctctaggaatatttatatgtaaacatctaaaaacgtatcttctctagctattatgctgaagggaaaaaaccccactctaattaaagcactaatgctaagttggatgaacaaaacaatatctacttccaaacttcaacaattatttatatacatgcaatccaaaatgaaaaccaaatgagaaatggttaaaatgagttttattatcgtgtctagactagtcacgcctgtgcagtggagccattatttaaatatttttaaactctgattatcaaagggggtagataaataattcaacactgtaaaaatttttgttttcacttctagatatgttgccattgccattatttaaatgtttcaagaagaaaataggattcatagtcattcaaagtgactaacggggagagataacctacaaaaataaattatcactttaaatcagggctctcaatcttagtactattgacacgtgggaccagataattctttgttgttgggagaagggggtcttgctcagcatgtaggatatgttagcggcacccctggtctctgtccacaagacaccacatgccagtacttattccctaccagctggtgacaaccaaaaccatctccagacattgtcaaatgtctcctggaaaataaaatcaccctcagttgagagctactgctttaacttagggactagggcaacctagttgaattctcaaatgtaactcaactctcctttagccctctagggatttcgtggtttgcaaacccaatagaatgactgtcaccatttagcttcctatgaccacattttaggaatcacctgagttttagtaggttttcatgtaatgcaaggccatggcgaggctttacagggactgaaataatggcaatattaactggccactggttttcaagagactaaagatgtaattcggaaggctgacaccaatgaccggaattattatggggcatacctgagaaagccatgatgcccaaaacttcggacaagaaagctatagtcctggcctaagttactatcaaaaatatgaccacctattagcctaaattgctggagtccaggacatgtgagtcatcagaagtctaccaggagagcttatccagcaagaatccgggtcacttgtagtttcagaataatctcaatgagatgagaaaacttgtatacttttttttcttccccagcggaaatatgcattaatatcacaacttgagtaggaataaagagcaccttcttggaccacaaagtcacctttgactccctccatcttccatatctttcacaacatatcaactgcccagttcttctaattccacctcctgtacagctcttgaatgagcccactcttttccaacacacctttcactactagaccattacagaagcctcctaatcagtcgcttaccttccactttggccccttccaccagacataaagcaatctttctaaaagacgaatctgattgcctttctccagtttgcattctttcatgggctttccgatgtgcttagaataaattacagacacctgcaagcttccgtgttatcaggaccatgacttaatataaggtgtcatggatgtggggcacagaacacaatgtcatgtgcaatgaaatcacacttatgcaggattttgtactacaggagtttataaaacccgaatcattgatagcacaaattgcatttaacaattccctaaacttccagaatctggacttttgggagctcaaaagccaagaatcaacccctctaagtttctctttgcatttctattgtacccttcctaaggcagtgaaagggagttaggccaaggttattttaaatctagcagggttgtgagttggggaagaagaggcataattaacaaaatttcactctctctttctttttataaagagtttttgttacactggtggagtctcactgcacttaccatgtgactccagtatataaaacacaactccaactatgttcaaaatatgcatacacataggcgttatatttccatggtgaggaggaggggattgctacacacagtgaaatatgcaaggcaaatgaactagaaagaaatacagccatatgtgaacaggaatatctctggatggtgagattagagatgattaatttgattctcaatactttcatgtatgttccactatcaataatggaatttttttaaactctaaatggttactttaagtctttatattaatatatggacctagatatagaatacatggcaaaggtaacattaaattgttttagaatgaaaagatttatcacctgccctgattcttctcagtttgcagatctttatgcccagataacagccccagaatggaaactgttgtcatttgatgctttcacacgtcatccccaaaatcaatcatctctaaggtttttaacgtacacacggagatatacaaaactgagggcgtaaaaatgtccagtgaatctgttaagtgttgcagttgaatattagtgcctgtgtgccgttttgtggaatggtgacctatcatgactgtaaacaaagagagaaaaacagttatgaagtatggcagccttataataatcagtgaaaagctttctctgccagcactttcaaatagaagattccatgaatattaaaagcttcaaattcaaatctccattcaacacacaccattgagtctctttctgtgtgctagtgacatatgagtaatgactttttttttttacattgaagaatatccttttcattatgggtataacatgatgagtgtgattagatacccatgtgctaaatgttacatactctctcctctactcacccagaagctgcagtatgggtcttggtcagggcatgaagtgaacatctgtgtggggcccaccaattgctctgtcaactgcccactgcatttctttttctaaatttctgagtgctgggctcaaatgtaagaatacaagctacattgactttattgcccagttgttataaaaatgtaaaagtttaagcatagattgcctatggagcgattatatgtgttttataattgtcaaatcatttaagttcaaatgaaaatgcatcttgccattacccaatttattttatatcaatttcaaaaggtgaatactggctccagccttggaatagcaagcccagttgcaaacattataggagtctttataagctccctttattacacacagtgtgtcttcctaccagtgtaaagcagggtagagtggagcggggatgtctcattcaacttcccggccttctagcattatgacaatatgatgactgtgaggacagacagagacgtagagcggagaaaaaacagtgtctcaccacctgtagtcccagatggcattggaagatactttactgtaaacccataaaggctcaaaaaacacataaagcaatgcactaattaaaaggaaaaaaatctacatccaaccatacatagttatggtacagattattacatacacagtcaactgtgacttctgaaatataactgagtcaaactccagcaaaacacagatgacaaaataaagagctcttctgttcctccttccactgatggtacaatggaatgcatacagatctattaattcaaagagttttcccattttcctcaacttgacatgcagaggagaatttttgagttgtcatcatccatcaccatgataagtacaatttattgccggacagtgctaagtgctcgcatacattatttaattcagtcctcaccactctttgatatgggaactatcattacctcagtcagacagaatagaaatggaagcacagacgagctgagaaagttgcccaagttcacacagcttagtaagaggtagaaattggatttgaact

SEQ ID NO: 1186 - DNA, 2829 bp, Homo sapiens
agaaagaccaggtgaggacacagagggataacagcaggagtctggcagccaaggagcaaggtctcagaagaaaccaaacctactaacaccttgatctgggacttctagcctccagaactgagagaaaacaaagtccatcgttcaagccacctggtctgtgataccttgttatggcagcctcggcaaattaatacaatccccatattgtagactctctgatcatatctccttcagaacccttaccatattgcaatttatcttttattcttgtgattttggattgatatctatctcccaggctataaacttcatgaggacagaaagagagggtgtttctccaaagtgcctagcaaatggttggctcttgtgatggtttaaaaacacaacctaaaaattctgttacactcctcccattgaaaggtagggtccatgtgcccttctctttaatttgggctcttagacttgacccacagaatatgacagaagtgatttttgacagtttccaggtcaaagggttaagagaattccagttcctctctcttagatactcagtcttggcgcccacccaccatgctctgaggaaactgagccgcacagggaggccatgtgtaggttctggctgatggtcctcactgtcagtcccaaacaatgccagcaacaactgccagacatgtgagtcaggaatccttccagatgaatccagctgcagctaccatctggctgcaaccacgagagaccccaagcaagaaaaaaaaaaaaaaaaagccatgcgcgataataaaattgtgttttgtttttgtttttgttgttgttgttgttgttgagacagagtttcactccgtcactcaggttggagtgcagcagcgtgatctcagctcactacaacctctgcccccaagttgaaacaagtctcatgcctcagtctcctgagtggccgggactacaggcacacaccaccacacctagctaatttttgtatttttagtagagacgaggtttcaccatgttggccaggctggtctcaaactcctggcctcaagtaatccacccacctcggtctcccaaagaaattgtttcaagtcactatgttttggggtgatttgctatgcagcaacaaatgacctaaatagcattctataaatagttgctcaataaaacactttctaggaattttctacaaatgctgcccctaaatgctttgggatgtctctgcaaatctcagcaagtgaccatcactctacctttattctctcactggtaggctctccaattaaatattcattcaggaagctcatagctaggaaaggaatcttactgttcagttttgaccctaaatacagcctaagctttcaaaatgcagtaaagacagaaagtcctagagagagaatagctttccaggccccattccttctactcctgagccagtttctgttcattggcatttgcagcaggccctgctgtttgtgggcataaaacattctggttgcttgagtgatgcaacatcaccctgtcttctgcttcctctccctgccataccagccttagcaaagctgcagccatcaccatggaaactagcccgggaagaaactcaacattcttggtcaaaccctccatgctgtcacccacagggagctctggaaagagagccttgtatttgagtaaaaatggttctttcagattctgggaggtaaccattgttttccccctatcaagctgcaagagagattttttaaaaaaagaaaaaaaagaaagaaactcttttattacaaagtcccttccaatataatactggctgtctaccctgtgggaactactaaaacaagtcagacagaagcctaagccccaacaatttttgagaactgagctgattctaccactaaccgagaagggcagagatacataatagttaagcacaaggcttaagagccaaagagacctcagttcaagtcctggctccattactcaggacctggtaagttcattcattcatttatgtattcattcagtaagtattttgtgtgtgcctactacgtcacaggtagttttgtcaaacactgagaaaaccctggggtacaaaacagacatggttcctaaacatttactgcatgcctgcttcctaccaccaggcactaatttagctgctgggaaaacaaaggtgaacaaaataaagtccttgaatttaaagagctttcactccaatgctggaaaaagaggaaaaaaagttaaaataaaataacattattataagaaccacgaaggggacatacgaaaagctcaaacaaaaaaatcataaaaagcacctgactttggaactgcggtcagagcaggcaatgttgcttgaactctttaagtcttggctgctctatctgtaaaacaggcatgccaccgcactgggttgacgtaagggttaaaattaacccatgtaaagcgtgttcacagtgcttgcatacacagacgttccgtaactggcagttattatcaatatgacacatgaaagtgccttgagtgactcttgtagggagaggcattcctccaatggccctgacccctgaatgttcctgcaaagaacactaaggcctgaacaccctctgcctggaccactgcttggggttatgttcgcagtgaacaatcttgagagatgaggtaatgtctccatccaggaaagagcaggcttgcagtacaagaggcagattcccccagctcagggtttctcagtggcaaagcaaactcagtgtgtacaatctccacctgggccccttcgaatcaccctcctcaggacttggggagcatgggagcctacgtaaacatgatgctcatgccacttgttgt

SEQ ID NO: 1187 - DNA, 2384 bp, Homo sapiens
tgtgagaccttgagcagaggacccagctaaaacatgccagcctcctgatacacagaaacagtgcagtgacaaatttgtgttgttttaagccactagatctgtggtgatttttaaattcagcaatagaaaactaatacagcctggaacatgcctaaccttccatgcagaatattacattatacagcagtaatttccaagactgttagataaaaaatggataatgtggctctataacaaatggaaagcaacatagaaatgttgtgattcttgtagacaattaagttaagagggtagcatatcgtattatcattgtcccttcttgcttcttaaccagtttatttgctgtctcccacatgcattattacattatatgtgttctcagcagtttcagcctgtgattttctggcttccaatgtgtttagacattgactcaaaattgcagtcataggttttgcttttttaaattgttaaaatgctatcattctatcaacaaatactacaacattactaaaactttttttcattatattgttcatgtttgctgttaagttagggaacttatttttttctcattttgtaatacaaatacagctataataagaggcataaaacccacacaatttatatatacttcattgtctcagattgaaaatcaaaaatacatagttcaaatctatagatgtggagcccgtagtagctgaaattgtgggcctatattttaaactcatcagcatcacttttaattttttttcctaaacacagttaaacatggtctgaaagtgccaaactccatcacaatttttttcccctttttcctggcccgggtttgtaatgagcttgtgtttgagagaaagagaaaaggagaaaataattggaactgtctctcgttaccactaactcctgtttttgaaggtttttctattgtttaacaccttccatttgttttaccttagaagcgtgattcagttatcaaaacctgaagaaaatgaaatctaacttataaggcttcatcataaatatggtgactcaagtcaggaaaaccaagctgtctgaaggcctggattttagattttcctctgaaatgaaagttggccctacagatgcctctggggaccatcctgacaggccaggtattctcaccatggttatcagtgtgaatacacataagctcttgtgatcaagggctttgctagctgctcatccattaggtaaagtctggtgggtatagacttgggacttactaccaaagggatcatatcctccaggattacctgactcactgaatcatctcaaagttccaatgtttacccttcagtctagcataatgaagggaatctgttttgatgtgcaatacacaatgtctcaatttctcagagctgagaaagactataaatattcaacagtcttttgcctaacacgtgtacccattcttcccaagctctattcagtaagccaccctactgttgctgctactactgatgcagctcctgctgctagttaacctttttgtaatgtttactatgttccacacacttggaggtagtatattggttatctattaccacataacatataaactccaaaactgagcagctaaaacaagattgatgatctcacacagtttccagtactggctttgttgggtggttccagctgtggtcattgtctcatgatgttgtaattcaaatattgcctgtggctacaggcatctgtaagctttatgggactggaagacccagtgctaagacaacccacacacttaacttgcaaggagatgctggctattgaaaggagacctttgtcccttatcatttggacttctttatggggctgctagagtctcttcacaacttggcagctagcctcccccaagcgagtgatccaagagagaacaaggcagccttagctgtgtattttatgacctagcctcgaaatcatgcaccatcatttctacaatatcttatcggctatgcaggttagtttcattcagtgtgggggaagactgcacaagggcatgaataccaggtggcaataatcactggtgcccatcttggaggctccaatatgtaggtataacacataatttatacttacaaagtgtatattctatatgctattctcaactattaaatcattttcctggtgtgaaggatatatttaagagagaagattctaaacatactgactaatgccttcattttcataatgattccgtctgaatttggatatttgaaaatatttactgacattctaccatctgctagtcacccttctgggtaccaaaaatactgtggtgattgagatagacagaatgacagccctcatgaagcatatagtctagagtggagaaactctgttttagtccatttgtgttgctataaagg

SEQ ID NO: 1188 - DNA, 2516 bp, Homo sapiens
tacaaaatgaaacacactccaccagggtaacagcactcccattcaaaacgagagaagaaggaaagaaaaaaaagagtccctggtcccaaatgttttctaaatccaaccagaaaaactccattaggtttcaaggcatggctctcagctctgccttcagagcctataaggtctgctctcacagtcatctttccttcttcataaagggtaatacttgtttgcagctgtagtttcacccacctgtttcctgtctgtagaattttggtgatctgacaaccttctttcattttgttctctctgtccctttcaggtcaagctggcagtgttttggggcacataccattcttaaaagccttgtgagtttcctgcatatgtcacatggactcactccatttgaccatcaggccaaatcaaacctattgcctctttttgtaaatgaagttttattgcaacacagacacacctacctgttcatttacatattgttgatggctatttacatgatataacagagtgaagggttgcaacagagacagtgtggctcaaaagctgagactatttactatctaacccttttcagaaaatgtttgctgatgactggcccagagccaaaacccaaataagtagtagcgtttaaacaaatgacaggcttgggtgggttgcaaaagcggggccgcttggaggtagtgaatatttcagatgttgtgcgggaggtgtgaggagaaaagtgagaagcggtgagggacgaaggaagaggaagtgagagccatggacttcagaagtaaacttgaacttcttggcaagttaccttggaagcctggggccagggtcattaagcagcaagattaccatgaaggaaaagagtgaaccaaaagaaagtaaggggagaaattcaaactgggctcaattgtgacagaaaagaaaaatcacacctagagcagtacactgagtcccttagtatgcaagaaccacattgcctcctcctcatcctccctctgaaaagaagcccgctgtgcacacctatgggacagcctttgcttaattctatgtgccagcggcagcttcccagtaagccttctcccctttgcttttgctccgtggaaatgagaacacgccaagggtgacgtttgtgtgtgggttttggcgctttcacaaaaagcttcattagccttatttagaatatgattgctccttcaatccctgtgcataaatggatttcaggtgaccatgcctgtcacaggcccctgctcgcctggttactggcttgaggtattctttggtttaaacaaagcaggacaaataaagagcaaagacccactcagggccctagatgttcatagaaactgatttccccttaaaaaaacagctcactgtgggagttgtaaataggaagaaatgaaccatttaagagagtctttgagactactgcctgttggaatggaaccagtttggggtttggggtggaggtggcatgtcaaatttgtggttacttcctaaacacacacaaactgtttcaatatctgatttgaatatgctacaactgccccctgccaaaaccctgcccagcagtctttctccccacaaacagctaagccaagaaccccaggacaatttgctgtctgtgctgatagactatctggggtttctaaagcaggcgatgtattctatttcaggaaatcagaccaaataaaaatcattccaattaaaaagtgccactgggcaagtagaacagcaagtgcccacctcacacaaaacagaccaaccacaaagtgcaggctttcatatatgttgttgatggcagagtcactgccttagagcctcgagtttattcaatgggataaaagttgcctggtaaattgggctgagaggattttttcccagaaggccatcacaaggcattttgatgtacttatcatttacaagagcctagaggaatctaaaagtgattttgatttcaaatactatagaacccagttattatatagcttattaatactgagcttcaaataaccatcagatatattctgagacacacacatatgcacacacatacacatacacacacatacacacacacacaccctctgtacaggcttgtaatatgaggcctgtgatggtgatgtctcatgttatttagggagtcgggttctaaatttctacaaagatgaaaattgtgtacagttaaaggtgcatttggaaaatcccttcaaatgcccactagcacagtgaggtgcttgcaccgtgagaggtaggaagtaaatctgattacttcagctctcacatgccccttgcaggtgaggatgggcagaaccaacaccatgtcagccctctttttcactcttcttgctgagggcatggagatgaattcactttagttaactgtataggttatataatttcaccttgatcagctcacccccaggagggttagtcctgtctacaaatacaaaagccactcgtgtcttttttgtaggaaaaattcctcactacctggtaaggaagaccctccattgtctcag

SEQ ID NO: 1189 - DNA, 1314 bp, Homo sapiens
tctcactaatgacttttttctgttccagaagtaaatattgcatgtagtgttattcattttggggataaagaattataaattagaaagaagtgcttaaaaaaacctccatcagtacatatgattactttttaattttatttttaaagagacaggcagggtcgcaatctgttgcctaggctggagtgcagtggtgcaatcacagctcactgcagcctcaaactcttgggctcaacgaatcctcctgcctcagtctcttgagtagctgggactacaggtgtgtaccaccatgcctggctaatttttaaatttctgttgagatgggatctcaccatcttgctcgggctggtctcaaacttctgggctcaagacatcctcctgctttggcctcccaaagtgctggggattacaggcgcaaagcactgtgctggccacgatcaccttttgaaattactttgtttccgtataaacatgtgtgaaagataactaaagtataccaactagtttaaaatttgcttaccaagatatgcatttgaaacacaagaaatgccctatggcaactatttttgagtgataaatatttatttaagaaatgaaaattcatctaactgctgcatgagcttttcttttctgtaaattttcaaacattattctcaactggattgcttgcaaaaacatttcgtacttaatagtctgagatttttctctaattttagccaataattcattttgatgggcaaatcacagctctctaaaagagaaatgttgataggcctgaggtttctgaatggtgtttctgagttatacagttatcccttgttatcggtgggtactggttccaagactgccccccattgataccaaaatccatggatggtcaagtccctgatataaaatggcatagtatttacatataacctactcacatcctccaatatactttaaattgtccctagattgcttataacaggggtcttgaatccctgggctgcagacctatactggtccgtggcctgtaaagaggtgagtagtggacaagtgagagcattaccacttgagctctgcctcttgtcagatcagtggcattagattctcataggagtgggaactctattgtgaactgcacacgtgaggcatctacgttgtaagcttcttaagagaatctaactaatgcctgacgatctgaggttaaacaatttcatccccaaaccatctacccctctccctgctgtcccgtagaaaaattgtctcccacaaaaccagtccctggtgccaaaatggttgggggccactggcttataatacctaatacaatgt

SEQ ID NO: 1190 - DNA, 1330 bp, Homo sapiens
tttctcagtcttctgtctctccatataatttaccactctgcccccactatgccacaggcttcatttttcatacacatgaaattcaaaagggatgcctctccgtgattttgctcctgcatcaatattaagccaacacattgagtgtggtataaagaactcagagtgaatttatttacattattgttctttcaaaataggtctgttgctaacaggtctctgggtatgcatatgaaattcacagagctataaagggaaagaaacaaatgccagatacacagcaccaagctgagaaaccaaatggtaagcagagacaatgaaggagctgagcttagaggttagcattgaaacgtagccctgactgctatatggaatatcaagcatcctactgagtatagagcattatatgattctcaagtaataaagaagtttggcatcagtgccctcattgtggctgcatatggtcaacaatttaaggaggagatgaaataagaaaaaaatgcattttgtagtctccatcaaagaaagaaatgagtgttaatattttagctcttctccctacctcataaggttaattaactaataatataattaaagatggtgcaaaatatagtaactgcccaagatagtcaaaagaaaagatagtgtttttattaaaggtaatctaagatggccaaagaaccaaaccactactggcgtttggtcgtctgtgttgaaggatagatattctgtaaaacgtttcagagaagctcttatccagaattaaaggaattgttcattttgctgtgagaaaacccttaagtgccttcagatatagtgcaaactgctacatctaaggaacgctcagtgacttaagtgtggagcagtgtgcttctagcttggaagctggaagtccagtcttgggaaacatcaccttctgggtcagctgttgtcttgggaaacatcaacttctgggtcagctgttgtgcacacataccacaacatccagagcaacagattatgtgctgattatcttttccagtcaccagtttagagctcatggggaaagacaaggaaaaaggaaaggatcagaattcctgcctgtcctccggtcttcaagcctctgccacagctgctgtattttgtccaaacaaagagatttgaaaatgaactttccagttttatcttgtattacttccttgttcaaaatgtgatctcccatccccatccctgtatctccaaagattttaataagaattgtaactattttggcaatttgaaatcactatttctgaagtaggttagagtgcttgtataagtctcccagaaagattatttgtagttagacaggaag

SEQ ID NO: 1191 - DNA, 1526 bp, Homo sapiens
tataccttctgcaaagtataatgacttacacttgcaaagtatataataagcatttttaaaatttacttaattgatatcactatttggtgagctgcaggtggcattaagatcatggggcagtggaaatcagagcaaatatatctacagtgtctggttctaagagtgaaaaatgtctgagcctggtaaagagcagaaaagagtcagggtataatgagcagagacaagtctggactaaagtgggacagactagaagtgattgttatagcctaggatcattatcactctgactctactggttaagttttctgcagaaggaaataaagattttgctagcgtgagtgagcaccactgtgtaggaaaaattatctagaaagtagaagaggtaaggagcttctccatatgggaagtagaagtaaataaattcttattggaagttgaaatggtattatattttggtaattaatgatttctttgaaagtctagtgttaagtattcaataaaaaattgcattgtgtcttgtccctacaaatcaagtttgcaatgcagtctgacaaatacagatgcttttggtttcaattttgaaaagaagtgcatgactagatttctgtgtacctatgaagatgtgataaattatttcatattttcatatgtcatttggaataggcttagaatatctaatggaccactatgttttttaatattgaatttgggtgattgttttattgtagaagcaattactctcccaaaggaagttttaatttaatggagcaaacattcggtaatcttgttattatgtgcaaatatgtaagtgctgctatgaaggacactagatattgttctcagttccaaatacttacacactttaaacaattagtttgatattaaaatacctttatagtttttaaaaagaccttacaataattaacaaaacatttatgctttcatcctttgtagtcaggaaagaaaagctgaaagtatgtacttgtttttaaaaaaaaaaaaaaataacaaacgtgtgtataatggcttctatgatgttggggggtggggagaccctgcctgtgatcttatgtatcacgagtaggtgatttattaagttaggttggaaagtcaaattaaaatagaaattaaaacagttttctctcatggttgacaaaaatccatatttattcatatttggcagatattttagcgtttttgaagaatctttggaagaatgttaaatacagtgcctgggctaccatacacagttgtttagtttgtggactgcataactccaaaggccccacattcctcaggatgggccagataattctgcagtgacaaatgcaccctaaatcagggcagattatcataacaatgttttgtttctttctcatgctgtataagtactgctgatcagctactgctctgctacatgtcaccttcatgccatacttctaggctaaagaagtgtctcctattatcaatttctgttcagggaaacagggaaagggaaacagtgaaacataatcagactcctaaag

SEQ ID NO: 1192 - DNA, 1588 bp, Homo sapiens
gaaacttgagcccagagatgttaagctacttgctaagggagaatcaaaccttaaatttgaccctggttccgcctgctcacagctcagctcctgatgcagggaaattgtgaggtacttagtgtaactgcttattattatctgtggactctgtcattaaaatagtccaagtcagttgattcacagattgatatgtggtaaagataaagcatctggttttaatccttggagattcttgatatttagagctggaggaaaatggcaaaacaagtgacactgagaagaagtagctcatgaggtaagagaaaagacaatggagttttggaatccataaggaaaaacatgtgtatcttattaaatagaaagtggacactatcaaattctgttgacagattaactaaaacaagtgcagagttggaactcatccctaatagactatattctgaatataagacaatgagtttcattgtaagtctcacctgctgatgaagataagaaataaatttattatttacaaaattgtccaagttgagaaatatgtggctggtgctaaaaacagtaagttgactaagaaatgagaaggagaacaaagaagagataaagtgagtgtggagagacaaagcaacagtttgaacaagtatttcctttgctgccttgcttcattagagcgagtgtactttgaggatatacttaaccagacggataagcaacagtattttatccaggacaattttaccatatgataaatatcctgtaatgtatacattgggaaaactaataaaaggaataaggcatacctgcagttttaaaacaggagtatattatgaaagtgtcctaaaacttttgtaaaacattgaacttctggtttccacttaggatgtaaacattactcccacctttgcgacaagcaagaaagaaaacaaacaaccaccaaataatcttcaaatttgtaatgtttctaaaattcatcaaagagctaaagttgcagggaaacctgaaatcaaagataagcatatccaaaaagagatgccactggatgctatagaagctagtaagataaatttggttaaaatttttaatgaattcctaaaagcctggaaatgtagactatcattcgaatacagaatccctgagaaccaaggacacaaagggagtttttatctacttgtgggctcttcacgaacctcatggttacttacagaaaagatcggaagcagcaagagagttctgagaatgcctcccatggacattctcaaaaccacccagatccttttatctttcctatggagcataaacctaaccccacgggggaagaacaaccatcttgttgctccagggcataggtgaagatccgctgcagccagaataagggaacaggaaaacatgctctattcctacaggagggatgggaataccttctaggccagaccattagagaccttccacagagagtgagaaaccccactcgtaagacccagaacattgagcctcctaaagaataaggctgggccgggcgcggtggctcacgcctgtaatcccagcactttgggaggccgaggcgggcggatcacgaggtcaggagatcgagacc

SEQ ID NO: 1193 - DNA, 1653 bp, Homo sapiens
ggacatgtttatgaacaagcgatgccaaggggaaaggtaaaagtggaatgtcaattgtatgtactgaaataaagttcatagagctgttgaatgtaagcaaataggggaggaaaattaaggcaattttctttccaagagcaactgttttttcctctgcttcaatcttccattctcttttggtccactgactcctcacttcccacccccatcacacacatgtgcacacacatatagacccacacacacatacacacttgtatttaatgaaaatctttagaaatggatagaaattacgttcttcagatactttctcagttcccatgctcagtagcaatcagtgcttccaaaatatcttaaatttctaaagtagactctgagcagataaaaaaacatcagaataaacaggtatttgtgaaattactgataaaatgcaaggatttaaatcttctttataagttataataaacaaatgcaatagtacttctaaaaaattctgtttacttactggtcatttcacccaaggtaggaaccattgacttacttttataaaataatcactttttcattcacctggagtggtaaaaaatggtttttaattaatcagcacaattgtcaatctttcagaaagaaaataaacctggattttatttcacattaaaaactaaactataggccgggcacagtggctcacgcctgtaatcccagcactttgggaggccgaggccggcggatcacctgaggttaggagttcaagaccagcctgaccaacatggagaaaccctgtctctactaaaaaaaaaaaaaaaaaaaaaaaaattagccaggtgtggtggcacatgcctgtaatcccagctactcgggaggctgaggcaggataatcgcttaaacctgggaggcggaggttgcagtgagccgagatcgtgccattgcactctagcctgggtaacaagagtgaaactctgtctcaaagaaaaaaaaaaaatcaaccccccccaccaacaaaaaaactaaactatagatgcactaaatatttaaatttaaaaaactatataaattatacatactacaaatacacatatataaaaatctatgtataatccagcagttcggatggattgtgtaataaagacaaaattccctgctataaaaacaaaaatcccaactaaaacaaataaaaaaactacatttgactatataaatgtttacaaaaaatatttctatggtaaaatataatacacacaaagttgatagcaaatgattgagagaaatattcacaatgcttatgagagatcaacaattatagaataaaatgagctactagttatgaattgatatgaaaatgacaaaaagaaacaatagaaaaatgaacaaagtgcatgaataggtagttcacaaaagaataaattcagcgagccaataagcatactgacagcagctcagtctcactggtaatcgggaaatgcttgctttaaaaaatgacacacaccttacacttagaaataaaaattataagaaggaataacacttcttgtaggggtcatagaataaaagataggctcacattttgttcatagaaatgatattttttaaagctttcttagaaagaaatctggcaacagctattaaaatttaaaatgtacacactcttcaact

SEQ ID NO: 1194 - DNA, 1773 bp, Homo sapiens
ttgagtaaaaaaagatgttgctttctcaagtgagcagagaacttcagaaagataactcaaggctccccgggcctagaagttccctgagctgggacataggtagtgatcctggcagtaacagtggaaacctaatgatggtctgaagttggatccagctgaaaggagtaatgagatgcctacaatgtaatatctgaatggagcttgctaccctgagatttcctcctgtaaagaagtttttgagctctaaccaccagataagtatgacacagaagacgccctggggaagttcaagaagaatgcatggcttcagggctgtgatcatcaggagaaaaccacttgggggtttgagtgtgggctgcacagatttactggaattatgaagcatgctagacacacctcacagggcatattgaatagtgaacattcccatatatgaacggagagcagagccacagaacctttgcttccagttgaacagcagcttagtagcatgatttggaaattgggaagcagtgattccattaattaagggttttaataacttggttattaaaaagtttgcctgggtctaaacttggaataagatggaaagaatttgtttttaccatgttgggcctaaattaacctggctacacaaagagttgctttttttaagaaaaaaaaaaaggcagaaagaagaaagaagatgtggtttaaattttattttaagaacaaaatagcttattttatatatatacacacatacacatatatacatatatacacatatatacatatatacacatatatacatatatacatatatacatacattctcacacatatatgtgtatgtacacatatgtacatgtatgtgtatatatatgtatgtatgtttttttgagacagagtttcgttcttgttgcccaggctggaggacagtggtgcgacctcggctcactgcaatgtctgcctcccaggttcaagcaattctcctgcctcgtcttcccaggtagctgggattacaggcacgagacaccatgcctagctatttttttttttttttgtatttttagtagaggcatggtttcaccatgttggtctcgaactcctgacctcaggtgatccacctgtctcagcctcccaaagtgctgggattacaagcatgagccaccacacctgacgcttattttattttttaaaaattgtagctttaattttatttgtaatttattagtgtctcaaaatagatgaccattaaaacatgacgtatgtacacctatacatggtgagcaagtatatctgaattattgagatttttgtacgagtgattatggtagaaatagagcataaaacaatgtcttaaatccagaggttatttttgagtttttaaacaaatattttattatgtgcaagtgaataatatccacccaatttattgatatgacagaggtacttggggaaatatttgaaactgttttacacatattcagaacttgataaactgatgatttaaagaaccaatttatctcctgtttttcaattacaacacagccagttaaatgttcactcgactattcaaattcaacttacttctgtgaaaagaataacccagttgcttttctttctcctttttctctactgtgctttccagcatcctttcagctatactttcacatgcccaaatattagagaatatttcagcttactataaggaagatgttctataagagctatttagagaaggggagagatgcttggggaggcagaaagcaccctgttggagaaggtgtt

SEQ ID NO: 1195 - DNA, 3424 bp, Homo sapiens
aaagaaaattttccaggtatggtggcatgcacctgtggtctcagatgctcaggaagctgaggtgggagcatcactggagcccgggaggtggaagctgcagtgagctgtgatggtgccactgcattacagcctggaggaaaaataaacaacaacacaaataccctgaagcctgcattatctcctccaaaccatatgaggtactgtcaaaatttgcatggtctccaacttgatctatactggtacattgcctcccagggtgggtgggtgggggttagtggggagatggagtgaggcagaaacctgctttaccaaactgagataagaatcaggaaaactatcccagctgtcgatgctggtgcagagcaagaaaggagtctaacactgtctcagccctcatttctaacattaattttggcaggacatggaagcaacagtggaaagcctccctctccattaatttggagctaagaaaaagaaaaggtcatcttctgagttgaactagtaaaactcacatgcaatggatgtgattagtcaccttttggagtaaagctagagaatatctgaaatggttggacctcagaagactgcaatcaaggcaaatgatttgggtgtaatcagaggaaggcaggtccagaatatgaacttcatttaatagaaggcatttaattaattgtgttgtaaggtgttggtgtgggggaaggttggacagaaagggaattggtcagcttcggctatggaaatcccaaggaatcataactaggcagtgtccaatcaagcatgttgtagaggagagaccctgtcctctgtgcccttatggttgctggagaagttgctctacttggggacagtagtgcctcttctctcctcagcactctgggtgccctttgtacagcacctaggttgattcctggtctttgttattatgaataatgctgcaatgaacataatgagtacaagtgccttgttcacctgtcgctggttttccaggcattctgatcctaggacaggctgccctggatggtggacataagcttttcagtccctgggaagaaatgtcccccactgtgagtttatcagttggtcatgaggttagactcatggatttgattaacttgagtgacctcagattctgaaaacttctgagatcttgacgagggtaaattgtggaatttggaaagtggtcagttcccatgagaccttgtggttggcagcatagccttctctcagaacatgctgatctcatcatcagtctctttctgccttcaacagacactatctacttaggtcaatgactgtcaaccctatcagactcaaaagcctatttttaaatgaatgttttattatgttctctttactattctgaaaagaaattcacaagtaggccaaggcaggagaatcacttgagtccaagagtttgaggctgcagtaagctatgatcttgccactgcaagatccagcctgggtgacagagtgagactctatctttaaaaaaaagaaattcacagtaatacaacctcctactcatatatttttttaaaaaagtcattattaaaaaactggtaaagagaaatactttgtaataaaattgtatgtattagcaaattctaatgttggggatgactcattggaagacctaacgaagtagttgctttgagatcagagtgaaggtggcggaggcaagtgtagatagagacaggtgtgctggcaactcaaataccaagagtaatgttgctgtcagtgaagtgtgtttctgaaattgtgactactgttggtagagttccaaaccaaagtacagtcttacttgctttaaaaatgcagagagggccaatcacggtggctcatgcctgtaatcccaacactttgggaggctgaggcaagtggatcacttgaggtcaggagttcaagaccagcctgggcaacatggtgaaaccccatctctatgaaaaatacaaaaattagctgggcgcggtggctcatgtctgtaatcccagcactttgggaggccgaggcgggtggatcacttgaggtcaggagttcgagaccagcctgggcaacatggtgaaaccccgtctctactaaaaatacaaaagttagccgggcatgatggtgtgcgcctgtagtctcagctactctggaggttgaggcatgagaattgcttgaacccgggaggcggaggttgcagtaagccaacatcgcaccattgcactccagcctgggtaacagagcaagacagtctcaaaaaaaaaaaaaaaaaaaaaatgcagagagagcatgtatggaaaattcagtgtacattaaaactttgcaaaggtaatctgtgtttctaagtaaaatggaattccatttcatacccagataattataaacaggtttttcacacaaatgttcagtgtgacttctgaaggttttatagggcacaagaatatttcttggttgttgtacctgtgctgcacatgactggatagctagcatccttggttccctctcagcaaatgccaccagtactattccaataattctgacagccaaaaatgtccgttcaagtgtctgatacatcccctaggtggtggtaccactgctgttgagagacactgaattaagtgaacaggaatcaaaatgagggtccaataatgcaaatatgctatttcccacagcacaatcattccatggcctggcatgatggaaaaccctgggtagcagaaagaaggcaaaggctgcatgagaatggggccaagtgttaggtctagagggggaagcaacattccaggcatgacaatatgtcagaacttaggaggggaaaccaggataacacttcacctctgggactttggccagcgtatgagtggggccaacatagaaagaactgtggctctgggccacatggatacccaggtttgtcctcggtgcctgagatcccagatctggctgaaaaggaaggattaggggtcagtgcaggagcctggaagcattggctttcttcctaaaatttgagtctagggatatgacttatttccagattccttatgcacagccccactcagaaatgccccgatgtcttgtatgaacttaagtcttctcaagtagtagcagcagagaagaaagcagaggccagagagacaacagcctccatttatcagtaccaagcatgtgactgaaaaggggatgcctataccacaccatctgattttcttacatcagagtattctttgtcctcattttaacagaaacgaatcaactcattattcaaacaaaaacatgtgctcaaaagaacaagggttgaatggtgttagcaaccatgcctcactccacccctgtccaactctgttggtttcctctggatggacacaaaacagctgcttggaactcagatttggagttcatttccacaagtagggtcatgaaggtgtggccatcaattgaggca

SEQ ID NO: 1196 - DNA, 2527 bp, Homo sapiens
ttcttttatctttgagttataagagttcattgtgtattttggataccagccctttatcagatatatcttttgcaaatattttttccccaatctttggcgtgtctttttattcatataatggttgatacatgtttctgctttaaggaggaagggttttaaaaatacaatttacagtagcagtaaaaataaaaatttattgcaaatgtcttatgttcactctcaggtgatgtcagggaactatggacccagcagggtttaattaaaggggagtgtcaagtcctgggggctgtggttgacaatcctcctttattggcaattgtgcagcagggctgggagtaagaagacaacccagtcctgagctgcatcacttctaaattaagaataattcaggaactgtgtttacggtgaaatcctggcccttctcacatagattatattatgcataggatatgaatttctgtccatgaatccaagtatatatgaaatcatcactttgaaaatttcctttaactcaacttaatcccactggtgagcctcaatcctgccagttgaaaaagagactgtaactgggtcatgcaggagtctccttcctttcctgcagcccagtcagaattcaagaagttcacctggtaactggaaaatgatggaagggcctcaagtccctagtctgtcctggttgccattggcacccttactatctgagcccatagtggtctgtgaagtccggcagctccctgcccccatgccacagtggggaatgagaatatctactgatgctgggccccatgagcaaagcatgctgcctttctaggcatgagccatcacacctgaggttgctaccccctcgggagcactgatggaggggcagttgggtttctactgctcacaggacccagacaaccatcccctgccctcccttcttcttgcacttcaaaagcactctcttcctctcttttcacctctaagccaccggtatcatctcttccatgggctttcacaaaagtctggatgaacctttgaacttgtatctcttctgctttcccccttgcatcaagaaagcttagaaaacaaacactaattaacgtttcaataaataatgctgctctaattatttgtggaaactattctgtattagaactaccatcagcaccgcctcctagagtgcttttagacttgaccactggccgcaggaggccacttccatataacaacaaacagatggctgaaattggaaaactcagctaaatgttcagatgtttctagactcccacgggtttctggctctggcacatggagtagatcctgactgtgtggtcctcaggggactctctctggtgaagtttggtgaggtcaacttccacacccacacacaccagctactgtgtgtagcctgtcctcctctggttgcttctacttgcagccttggcctcttcagtcctgagagcgttggagaatgaggcagtggaggaagcagccccacacagaaagcagtttctgaagtaacctcagcaacttcctcctcaccaaacacaaggaactgatcttctccactgggctcggcctctggtcagccaaggacaacactgttgaccaccatcacggttggccccactccacccttggctctgatgacatatgtgggagtcagaggaattttgattggctgactgctggcctgtcacacaaacaagatggggcaagggggttgcgatatgacttgacatgtgaaaaaaaaaaaagccgtggtcagcaaccccctgcaactgttgaaaggctaattcaatctctgactctttaacaaaagtgatcttgttcactgcctgttctgccctgagagccttctctgctaggaggtaggttgactgactcagggagaagggtgctggtggcagagctgccaatgggtgagggtcctagagactatcgacatgaggggcagttgagaacactgtagtatttagctgagaggagagactattaataaaatttacaaaatcagctttcagctatttggaagggtttatataaaaggataaaataatatgttctggtagttctagaaaacaggacagagacaagtagctggtacttatggattggaggagtgagtggcagtagtttggggattatttataaaaaagacatttttctgttaactctcttttctaatagtgaatttcccaacctgacaagtaagaaagcacaggctagacacgcatctgtcatgacactgaaggggtccttgcttgagtgagagactggaatgatgagttttgaggtcccttacagtccagcaactctagctaagttggagaataagagaattccatgacaccatatcaccccctcatttctgctgcctgcctcaccattcatctctctttactccttttaatatcattctacgttacagcattggaggaggctgctctaaataggaactgaaataagtagattaaagaagtgctatggaagggaaaacaataaaacaacttgttttttaagagcctactattgccaggatctg

SEQ ID NO: 1197 - DNA, 1307 bp, Homo sapiens
ctaaacaattaatttcagcttcaaggaacctctatccaactggaaagaaaagaaaatacgtggagtaataagccactctgagctccctgtgaagaccctttatcttgtagagaccttaggcagctgacaccacagagtacaaaatggcagcgctgttaagaaccaagacagactggaaaatgatgtccaagggctaattcagctaagagtgagaggcaatccttcctctgcactgcaagttacccagagcagagaatgatgaaaactacaacggagcaggaaagagaaaggaaggagaccaactcaggccaatttctcctaaatctccctttcgcagattacttcaaattctgcattcttcccccgcttccatgatttattcttccctcatcaccatccctctgcgagagaaactgtctacaggggtatctagggggccacaacacaacttccagttccattaaatttcccctccctgctcccactcccaacccccccacacacctaacatccttcctattgacacgtgtttagttcagctgtgtaaaagcctaactgcagtggcttaggtaaccctctagtcatttaagcctagtggcagagggctacttaaaaagaacgtaaattatctgccattacctttctcctgtctaccagaagaaatagctgactcttcttgtggtcaccttctaatttaatgtttctaatcaattatgtgtaagtaattaaaaactaagctttatagatttatattaagttgaaacagagtaaacagttttcggtcggggcttttaataaggaattaaatacataggcttttaatacaaatgtttttgacaattatgtccaaaactcggggaactgtctgggctcatcttcagaggacaaagttaacagaagcattacaaatggacaagttgggcactactactcatttttaatcaaatatacaaggctcttaaaaatgcttgcttgttctacaagggtcaattaaaaactgggaaaaaaatgcttgctgaggttttttgtaatgggagttttatacaattaatgaggtctttccaaattaatatgtttatgtctgtattctaaaattcagaaattatgaaaacctggagaggaaagacaactaatgtgtgctgagatgtaagacactgtgctgggcacctttaaatatattaccttacttaatatttacaataaccctcaagacagtaacagcatatccccatttaacagacaaattggggcttacccaaggatacatagctcagaagtaaactgggatttcaaaccagacttacctg

SEQ ID NO: 1198 - DNA, 2997 bp, Homo sapiens
taggaaccaggctgcagagcaggaggtgagcagagggcaagtaagcatttagctctgcctcctgtcaaatcagtggcggcattagattctcataggagcattaactgtgaactgcacatgtgagggatctaggttacgtggtccttatgataatctaacgcctgatgatctgagtctgaagtggaacagtttcaacccaaaatcatctccttccttccccaccccatgtccatggaaaaattgtcttccacaaaactagtccctgatgccaaaaaggttggagacagctgacctatcactgtaatgaacatggagatggaccacccatatcttccttcatgcctgttgcagctgggagtgcagttagcaattagtcctcatctatcagcctctttggagatcacctcagttgcaaagtaaactataaacaataaagaaggaaatatcctgatatgaaattgaaggtggtttctgccatattgggaggaaataaaagttctgcctgagttagagatgcctggagagagggtgtgtgcgtgtgtgtaaaacagcagtgctgaaacacgagttgagacctgccctctgcctccttctttaggaatagatggaatagaaactgtaaatggacttaggcttgaagtgcctgggccaacctgtgccagcctgggccttagagtgcctgggccaacctgtctaccacaaaacagaaatggcagaatggcatcgtgaaggagaggagagagatgagaaagcatattttggttttccagtggctgaatgtggtctgcagaagtttctacaaagaatgggaatgggccaaagggccaataagctgaaagaaaccttcactttgaatgaggagggcatagagaggaagttggcagggaccatgaatcatcagcaggttctagagctccactaatgaccaactggatccatttccaagaccacttagcacagtggatatagacatctacttcagaggtggccagcagggatccagatgactgcatgagaactggactctcttcctctgtgttgtgtagttatacaagtacccactctgaacccagataacatactggaaagaggacaggaaggggaaattccttgagaggggagaatcacttagataagaagtttgcattttgaattgactatttaaatcctcagttgactatttacaccaacatgattgtgttaacctggacaagactgcagtgaattggaagtgacagttacctccaacaggcaagctaagttttccatcaccaccaatcagaaatgagggctcagaagcaagttatattctgttgtaaaaaaaaaaaaaaaaaaagaaaaagccatatctcttcacatctgaagtgctgaattgtaaataaaaaaaattaagccacctatgtacatttaaaagtaacatgaaacacttgattccaccagacatataactgaaaagtgttccacgataggaaaaatcaaaacgatatacagcatttacccataagacaaatacggcatataagaacaagccacaaatccatatcctgagtcctgcaccggtgctctaaaggcttactcctaatctcaccccttccgctattatgcaagggtaccttgggttggggctgcctttatgattaaaggcatctcaatttgcccatagtaaaaataagtaaaacccaacgattttcatcacaaaacactgagcaaatgctaaatgacaataattaaaattcagaaaaaacaagtcttatccctattactcctatctctatacaccgtgccggatatgattctgagagacttctggaaggcagtggggaggggaagaggaggcagttgctggcagaaaatcagagaatctgcaagttatttgtgcataaactgagtgggacagggcttgctatttgaattgtgcatgcttctgttttatcgaacccattcctcacccacacgtattataggagctgtcatctcttatttacacactacagggtacgttgctcaaataaagagggcaaagcgatatggagcacatagaaaagaagagcgtttacattgaaagtgtgagtatttattaagcaattcaacacattttagatacatttttaaaagatgaagtaacgtgtgttgacagtgtccacggtgaaaaggagttattttctccccaaatattcagcaggctgtttgaacaggtagtaccttatttctagattgttgtttgaaattgtcctagttccagctttttaaaaatctccctgagcgtcagttttattttgtgctaagtgggaacaaggagatctcccttgcagggttcctatgaggatgaaatgatactccatatatcaagcactggaagtgtgagtctggcacactctaggggccttgtcccctttatcggtgggtcaaaatgtgcccctctgttctggtttccttagccttatattgagggaggagattgaggggatgtattgccatgaaacctttacaaagagcatggatttcttctccctgacttggtctaaatatggccttaacacacacaaccaaatgtcccttggatagagctgctagaagatgtgggaagcatggggaaggtgagcagcaaaaaacaacagaaagatggagagggaaaattagaaagaagtttgtccctccatttccttatctctggttactactctgcacacacctcatcctcgtcccctctttagccccagtctgtgttgcagttacagcatacacaaatgtctgctcactctctaaggtcattatgacattttgcttagttcctcagacaggtaaaagcactctttatgaattagcccaagaatctctgtatgttctttttttttttttttttccgagatggagtctcgctccgtcacccaggctggagctggagtgcagtggcacaatctcagctcactgcaacctctgcctcccaggttcaagcaattctcctgcctcagcctcctgagtagctgggactacagg

SEQ ID NO: 1199 - DNA, 2875 bp, Homo sapiens
aaagaaaatataacaatcatgaatatataagtcataatatatttagacaatgaaatacatcgcgacaattaaaacgaatgagctaggtcttcataaatcttaaaaatgcattattgagtggaaaaacaagatacatctcaaaacataaagaacgatactttatgtgtacttttatataagttctagaacatagaacaatgtatcttatatatggataaatatatagtccacagtttttataattgtatgacatattttatgcttaaattaacgcttaaattcatttttctgctcctttaatctaggaattgcagggaataaaggaagtattttactccttcatagtatctgaatttgtgtagtttttaccaatggaagctaaatccacacttgggttcaaattccagaaaatatacaggatgcctacaatattcctggtctgttgttttatattgggaataggaagatgaatgagatacagcccctgccctgagggaccttccagaatgagggataataaaagataaacaacaatgtgatgtgacagatggagggatgaaaaagttcagagagaacatacccatctctctctgtgggctttctggaggaggtgcctcctgcaggagtttgaaagaatgggtgtcgctcttcagatgaaagtgataggtgaggctggtgggaacaaaagcatgcagccagatcagcaaggtctgtgtgggcaccccacgtggtttgggcatgaagttcagggaatggatggcataggtggagagtatgcctggccagagagatgggcaggggaagatcactgaggacaatgtaggcatgccaaagaactggaacttgaacataggggaaaacaggagccaccacagggtttttttgttgttgttgattgtttgtttgtttgtttttttaagcagggcaggaacatgaccagatttctgttttagatacttcatccagacagccaggtggaagagtcagactcagagccaggaagtgactcagagagggggaagatctgaggcagaacctggggttggagaagtagatacacctaaggagatttagtaagattggcatgagatggtgaggaatttggaaatacagccaggttggggcttggttgattaggagggggtgatctacagggtttggggtgggtggatgtgtgaagacaattatgggttcattttctgatgcttcatggctctgaaggccaccaaggagttcaatcaaccccctcattctcatgactgtggactgtgcaatttatccaggtcattgacaaaaagtgtgggaagaaatgattcgtaaattatttcagcttgtggctttttgatatttccttgtaataattatcttgaattcacattatctgctttatgacaaggaacactgacacaaggattgcactgcaaagttaagcattgctgaattgtattgaaataagaggattgctaatgtgtattcctgacattttagcagtatcaaatctgatttcatcacatttacaaggtactatgagctgggacccagaggcggtgtgttatcatcgcctaacatagtgttccttaattatcagcactctcacacttcctgcatagcagattggaattgctagaaatagcacaaacttgaaaattagcgtttttctcttaaataatcaggatgctatatttatggtttttatgggattggtgtcttcacgaaggtaaactaatttcacactcaaaggtgaggtatttttctcccttcttttactcccccattttctagagtctattttttcagtttctcaaaattcatgaataatcctcttcatttcccccctccccaaaagggtgtttctgcacttggcttgcccttgtgataattcactatgttggcaatgagcccatgaagaaatggaagattttgctcttctttacagttactcatcagcctgtgacattagcaatacttgatcaaatgaattgcacaatttttaaacttcaagaaaagtccaaatgccttgtctagttcactgagttctgaatcacatatatactactgcccatctactgacaattgagtggaaaaggaaaagagaagtgagagaaaattaaacaaggactaatgaatgggtagaattctgagtggtctttggcacagaagtgcagtagatgtattcaatgtaatgaggtttcctccacatgtagatcatttttcttcccctgtaccaccttatcctgcagcacaggcacatgattccctatggggagccccatgcaggcccacttctccaatatggatccctggtgtagaatccctctcctatcagattaaaactgccatcttgcatttagattgatactgccaatcttagaaagtaaaattttggagccaattaatcctccaatataaatggggagtgttcagcatgctagtgattctcattacgggaatttcaggaagtgtgaagaggtaaagtgtggaatctgaagtcctgggaaaaacaaagtattcaaggttttggatgcctttccagagttccagaagcttttagttatgctgtctgttcataaggccaaccttggaagaatgcacagccagtactgtcagcatcactcaagttgtactctcttgttatacttctgtggtgagctttgcattgaatgacaggttctttctggcaaagacattgtaaacttgagggaagaagtgtagctaatacatctttgtttttgcaatgttgtagctgtgcacagtgcctgactgttgtgggtgtttggtaaattgattctgataatagacaaggagagagaaatagagcaagagtgagagtgagagcgagagcgagagcgagagagagagaaaacagagagacgga

SEQ ID NO: 1200 - DNA, 2243 bp, Homo sapiens
gtaaatggcagtgccaggacccaaatgcaagcctttcaacttgtaccagccagcgtcccagcaggaaacagatggcattctcaagtcagataattaatttgaggaacatttaagacagagactatttataaagatgtgggctcggtgtggggacaccacaatggctaatgcagtgtcccagcaacagtgggaagtcattatgacccctagacctgaaggagcacacaaaggaatggtgacttgaaccagaaaggagagagtcctggggagaggactgccatgagaggagagggactcagctagccacgagcaacctgacttcacttcccttccctcccttcagtttcctttcagggctccccattgctcaaactcaacaggaagccagaggaggggggcaccctgctgatggaggtcagtcttgctacaggtcagcctctctactgggcagagggtaggtcggagaagagtggaccatgcatctggaggggcacacaaaggacacccctactctagtctgaggtgcgctagaggattatccagaggcactgaattcattaactcacacctgtcgagacccatctatgagctagaccttatggggggacacccggctgtgcttccttccaaaaagcacaccctgcctattatcccatttcagagcttcattcatttgagtctctccagaatattttggtctcttggtattacatttttactatgattcttctggatgatattgcagctacagaaatgtgttcaaggctgagtccagaaaagggcctgggagtgggagaaggtgggaaactgccactggagagaaggaaggtcattaggtggggctggtggaatagcctggaggcgatgctcacctttcccacgatttcacctgagccagcagccttggccagagtttgttccaacacatatgttcaaagatgtcaggctggaggaaggaagaaagctgtagtattggaaagaggacagcaaaaggtgagaaacaggagagctaaggaaagcaaaggtgcgtagggtgctttacccaacctccactttcagagaagattcccagcaaagagacagtgtgtgccaatgtcaggaaatgccatgcatccgtaatccaaacagagaagagaaaagaatagcagaatgacaacaaaaggatttctggagtggtattaggattcaatagctctgacaatttgccaggtggctgcactgctgaaacatcgattagaattggtcaagcttccaaactgcctccctagaacaagcatatttagaatcccaagcttgtcatcctgaattcccaggatgtgtttaattaatgctactgctatttaaaggactcatgatcatctggcccatataatgggaataaatccaaatttatttttttttaaagaaaaatcaattatctctatttctgggactttcttaacaccctatcaacttcatttctaaatcttttgtctcctagctttttccaaagggagaacattaccttggcatagtcatggggcggtccccagttgcttcatgtttgtgtttgtagataagtgggaatattcagactcagagtttctcgcctccccagtacagagaaagactagaagattttgcaaatgtctgtgaatgctttttctatttttaaaatttgtgtgtgtgtttaaaaaatagtatattcatgtggttcaaaatccagagagacaaaaaggtatgtggtgaagactccctgccatccacgtctcccttgtacccactgttgtgttttaggaagccttctggaattacttcttttacaggcaagtatcaatatagaatcataattgtctctcattttcacataaaaggtagcctatttttcagatacgtgtaaattttaaaatgacattctctaaagaaattcattgcagaagccaagaatacatttttattaaagtttttcattaaaaacatttccttgtcaagtaaaatgcagatagttgctctaacttctggtctataccacagtgtaggcagcagaatcactgagggctgggggccctggcaaggattacatattatctatcttcgttgcttgaaaggacagcgattaagtatctatataagatacaagttaaggctccatccagaggcttgaaggccagtgagctgagtgcagtgttccgggagctctgcatacctgcccatcttcctgtggcttcaggcatctgagcaaaaagaggaaagcaaggtggatt

SEQ ID NO: 1201 - DNA, 3133 bp, Homo sapiens
gcaatctctgctcactgcaacctccctgtctgaagttcaaatgattcttgtgccttggcctcctgagtagctgcaattacaggcatgcgccaccaagcctggctaatttttgtatttttagtagggaaggggtttcaccatgttagccaggctggtcaggaactcctggcctcatgtgatccaccaacttcggcctcccaaaatgctgggattacaggcatgagccactgcacccggacaggtcatttttttaattgtgaaaagtagttcaaaattttttagagctaaatattataaaattattttttaaagtgacagtcacttgattttcttaaattgtaattgaatattttgcaatcaagatttactgattattaatagatatgctaagcattttaaagttacaacaaaaaaatccattttaagggattaagtagattttactcaaatatgggttatttaaatgccctagagacaaagaacaaacacttgctcagtaaattatgattttcttccttaaccattaaaaacatttgtttttgtgttgtgatgagtcatttttcagttacaaatttcctctcgattaccttctagtatttttgagtgagaaggagctatttgtttggttggataacagtctccaaactcattaaaaataggtggctatagcaacattcttgtcacaactcactcacttctgcaaaacaaatattgacaaaatatgtttagttaaagacaaagaacaacagaaaaacaatgatattcaattgttccaaacttcgagctagcctgtgaagccaaaagatcaactgcatattattctgaactcattgttctattttctttttaataagattgttttctttgtttttatgcagttttagaagtattttagacctttttgattgtatgcattttggaacactgacccttaagcatacacactgtcttattatttcgatcttaggctaatatgtctttcttttattaaccagcctgaaatatctcttttgcccttatctaagaaaaggaaaggaacctcatagtttgaagaaggacagtttaaaaacttaagcctctagcttacttcatttctcatcatttcaaacaacgaaagatccagacagtagatgtttcctgtctttttcaagatttaactaatatttttccatcttgtttaaagatttagaattgtagtcttttcagagacctcaatggtttaccataaaaaaggcttgtgcttcaattctaccccataaattcttgagcgagtctttggttggtcttgtaaaaccaaccaaatgtactatttcccaaacctccgagtcctacttatgaaacattagaaaaagtatcttatctgtgtgtatttttctactaagcaaatgagtccagatttcttaaagttggacatccattccctaagacagccttccctattcagactaccaggacaaaaatcttgcctttgggatagaaaagagtgaaagtatctattatgtcctccacccacaaacatcatgctcaaggccatgcatcaagcccacactggtgtggagagacatttttttttttcatcttaataggccatcacagataatttttaaaattttagttataaaaaccacttgtgaggttagattgaggatcctaatctccatttcttaaaacatgtaggttatgttcccctttgctgcttggtagagactcttaggctgaggtgctattatctgggacatcatttgcctacaggctaccatcagaggctctctggaacaactttttttcccctttaattctgttttaccctagagtgcactgcccttttatacctgatatactatcattagatagtttttctgtaggttaaggcttttcatcttcagaagttctccatcaaaatgcaaattgccctcagagcgctatgaaacagacacactaagaggctatttattaggcagaatccaggggaagctgaaactctcagctcaggatttcattatcttctaagagtattttgatgctgatttgaaaccttgtcttctggcttggaggcaagcaaagaatgacagagcgatctctagggccagagcagagaggaaaagaacaagacctggagcaaaacagaaaggcagatctaaagtctcagtaattgttttctgaatcaaatagcattaatgagtcatctgtcatctgaaaatgctcttctcattgatggttggagagaagtgcagctttgtgggaaaatagagcagttgcactgaaaagacctgaacttaaagcacttgacttaaagagaggcacattttaatgcagagcttgagtctggtggttttaatgccagcattatattcaccagctgtgtgactttggacaaaactgcatttccttagaccctccacaaggtagaggtgacagtcagacctatttaatagggttatttggaggatttgatcagatgtcgtaggtgctgggggaaaaaaaaagtcagttactactatgatgtctaacaaatatagagttcttactatatgataggcactattctaagcattttatttaaatttattcatttaatttcctccatactctgatgtaggctctttcaaaacccctactttactgttgagaaaactgagaattccatactgaagactatagcaataatctctttaatgggtttgttgcaaggctttaataaaatactgtgattatgcttaagtaatactttttaaaatgtaatgtgcatatgaatcatttgaggtactgttaaaatgcagtttgtaattcattcagtaggtgtggagtggaacatttctatcaagaaaattctgtatgtctaagaagttcccaggtgatgctaatgctgttggtccaggaaccacactttgagtgtactaggaaactcctgaaaaattttgcacttttggtttggatgcttcttttttttttttaattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccagagtgtgatattccc

SEQ ID NO: 1202 - DNA, 1937 bp, Homo sapiens
gtggctttgcaagtaatagtttcagatgtttgccctgggcctcacttctctggctgcaggcctcctgctgctgatgctcccacgttttatgtaactgtcacacagttttgatgtacatttataattttaatattctcagaaagctctagaacaaaacctttatgaatacagagggtgtcttctaatcttttaccaggaaatggatgaaaaacatttgttgtagacaaagaagttccagtatcgaaatgattttctaatttgaagtgatacaaaactatccagtaaaaactcttttgtcttgagtcatatcatattgaacatacttgtatttgaactagctctcttctctttgattatatgattttaaattgaaaatgatgaaaaaaaaacttgaaataataagttgaccggtatttctcaaactgatctggggctatattcttggggttacatgtgtgttctgggagaatcttgaaggttagggcttttgttctgatgatagtctgcagctaatctgagcatcttctggaccatcctgtaactgaatactgggcttgcattctgctcctgtgggcgccaaatgatcacaacttcctattctaaggagaaagaccaggaggggccaaatgacatcacccctcacatggtggaatgcatctgcttgaccccaaagaacctgcaccttagcagtcagcactgcattcacattcccagaggtgattcagtttcagcaagagcacataaattggtcacattaaagtaatactattagttggattttactggttttgtagttttatttgcatttaattttaaaatttgttttagtgtgatgcttgcttaaaagagcaataagcatatgggtttagttttacatttatacatacttaaataacataatttttgatgtaatgtgacattgtgtcttgggtttttttttccccgcaattgtctgaaagctaatcatataaccagtccattttgagaaatgctgcaatgggttccatttatgatgctgacttttctggaaaagtttgtccgtgaccaaatagcctcttgtatggcacactgtatgccataggcactcaataaatcctcatgatatgaggacagcccttgggtcttgccctcattctgccacatgcttgtgagcaagtctctggctgatatgaccaagtaagtgcttggatttaaggatctcgttagctccttccatctctaaaatttgagtcaagaaaccccagagatttctgccatttgtttatttttctgcctcactgtgccacctatcctgacccataaaattggatttttttttcaacttcttagacatcagcaacaacaatgccatatttgagtacattcaatcagttttcttgaaacacaaactcaacctttcttgttggaagttgtagtctttttattttccttgaaagaaaataaataaaaggaaagcacttaacctagacctttggacatatagaactaatacatccctttggaaagaaccttaatatctctgacaaaggctgctagacagaggctgaagcatgttaacagtagcctccctgtctctgatcctgaggccattagttctcttggtgtgaaatcgcccctgcagtgtgacagacctggatgctgaccgtagcctcgcacaccgtttcgttgggggctttggggagcaggaactactcagctatgggagacacaaactggggtcctcagggcagtccttatgtttaatgaatcagtgagcttgtttgaacaattttaatgtagcccagattactagcttccttagtttctttgagtgggaccagcagacctggagaaaaatggaaagaaatggaaagagaaggtgttttcccaatggagtagagactaccagcctctgacatggtcaactagccccaactagaggcctaaatcaacttcag

SEQ ID NO: 1203 - DNA, 2034 bp, Homo sapiens
tttcagtattctctaaagtgactcttgcttccttactgaggctgtgatctgtaagagccagtcatagggttaagctataaagtatttttagaataactaaatttttttacttgtgtttctaaaataacatacatagctcaccccaatatttcatgtaaattcccttgtttcctccctattcagctgccctcacatctatagcttttattccccttctctaagatactccaccatcatccgtgcatttttatttctcctcatctgctgtaccttcttaccaaccgatctcttatcttgtccactcctctctaccacagacttctcctaagaatttcctcttctcatttttgcctttttattgtattgaccatgttgccatccctagccctaccacttggccgattctgcatcatagaaactagcttagcagcatattatcatggatgtgaatatatttttgagtagggaatatgatcaagagttctatagtatctttccaaaaacattttttagagacaaatcttttctcccaaatattcatttagtttggaacatctctgctcttactgtaaatcacagtgacattatccagggggtatctagggataccccctggatagtctgctttttgatcacatcccatgacttcttatccttctctgttctggccagaaatcaatgtgtccatttttttctaggccagctaatatttgaggattgaaatatcttttcaggtatcttattatttggaaatacatgataggctctaactatgacagataggaatctgttgctctcaagcagtcatcctaaggaaactaagctctgaaggcttctggaagtatttttaagaagtaggaagctgctcttgaatttattgcttttctttggaaggaaaggaagagagagtatttttaagaagtaggaagtatttttaagaagtaggaagctgctcttgaatttattacttttctttggaaggaaaggaagagagagagagagagagagagagagaaagagagagagagacagacaggttagcagtgtgaatagtgggcaggggacttcagagccttccgctctgttactgatcttgtggctctctagcaagaaggctcttgtgcttttgagcaagtcattttacctgatttccatcatctgtaaaatgtagcagctcaattgaatttttcagtctctaaaattttggtatcactgactcacagatacagagaaagtaaatgagttgcctaaagttacgtgatttactcatggcggagccagcactcatccccctcccccatctaggtccctgtagttcctgccttgtatattggtagtagattatctgagtgtagtttggacactttctgtgttttctgagtggactcctcattaatccatctttagtcaatcaagcactcttggttattacttaaagtgataacattaggttctttagttggtttcctgtttttgacctgttggtgaatttttaccaatctcatgtgacaaagatcgtggaagctttaaaaaatgttctctaaaatcttaatgcaaagtggcattctccttcccttcttagagacattagctccactggaggaaaaaggcacaaatgcctatttcatcttaaaaatcaattatcttgccttacaacataaagcagtattttacacattgaattatttgagttccaccttgacattttttcttctttgattgcccccctgctgttattttcttaacattttttctttaaatggacctactttattttacttaagtgtattttcaaaatttgataactgtgaactcacaggttgatttattatgttgtttccaattcactttaaagtaataaactatatataaaaaaagctttcttgtaccatctgaaaccttctcatgtgtatatacagtactttgggaaactttgcataagaccatctgggtctactggttgaatggtaagagaagggagtaataaaaaaataagaaacaaaaatgatactgttataagcttataagccatgt

SEQ ID NO: 1204 - DNA, 2928 bp, Homo sapiens
gaatatgatacatactttaaagcaacaaaagcagagctccctggaacatggaaggcatggaatatggaaggcagtagaaatacaagtttgagataatatctcagactacaagagtagaacagtagcagggctttgtaaaaatatagatagtgagaaataaatagtttaggatgaagattaaagaaaactttcttatcaatattaattctggtctacgtattttctgttcattgaagctacctagctttttgaaagtagttaaaacaaatcacatccaaaactaagaataactatgcaatttatgttcaggaatttatcataacattatttttaaaaatttatgtgcatacatttttctttttctctcaagtttattttttattttctgtgtacttcttcatttctcttggcaatatagtgttttccctcttgtatatataagtgttttgcttttaattgctgagattttatcataaactatctagccaaattcctttttaagtattgtcactatgtttaatgaatactaaagcgtggcagagttaaggataatcaaaaagggatgataaagtgttcctgggctagcaacagtgggaaactatcactaccccaagcatgtaagggcaagaggagggaatcatgttcctggaaactagcaggagctgaacatatgacggagggaatgcccagctggagcaggaatgcagccgctgcttgtggtctgtcagggaagaatccaaggagatgaataccccaactttgctctcctcttaccctctgatctcttgcctccccttggccaaacctacgagaatccagaaggtaagtgagcccagttgatgcaggctgtgcaggtcagcctctcagggcagagcccagcagagaagagaaagggagagaatgattctgaaggggcaaaaggagaatattcagcaaagaaagaagtttttttaattctttgtattgtctgtgtttggctattagcctatttgaatgtatccactgtctaactgtaaaagttttgagttttggttagtctttctactcaaatggccccataatggttacaatcaagtcttcaagaaactttgttgttggttttcttttttaagtagtaggctatatttatattatgttttatttatgatcacaagcatggtgtaagagtgcttttactgtggaagtttgactttaaaatggcctaccaagaaggaatatgcatcctcgttacatttggaactataaaaataaatacagtgttgttcacacaaacaaataatttttgctggatagttgtttatcagtttcctggagccttgttttataaatactcataaacttggagaaaaagtctacttgagagaagttgacactatatgtagtctgcttattactactttctttttttttaaagtgtatcttacatttagaaacagatactataacatagaagcaaagatgactgatgagattttttcaccaaatatttatggaaaccttccacttaatatgaacacacagagataaatagtgtaggcgtatggtgattaccaagacagagtccttgctctaaaacagtttaccaccaagtagggtatttaagtgcataaacaactaactgtaatgatgagtagtgtcccataaatactgtcttacagggacaggtaatagtataggagtgcacagagtgatttcagagaagctagtgtttgagctaaaccttgagtggtgaatacaattatggtagaggagaggagaattcattttgggcttagggaatggcatgaataaggcacaactcaataaaaatacaaatatgaaggtggggtaagaattattcaagaccgaaccttggtgaacaacatatacaagcaatggcaagagtgaagggtgttcagaaacatggtagaagattaggttgccaagagagaacagggctaaattgtcaaggtcctgagtgctttgctaataattttatgttttctacatagaccttagaaacgtttttgtaaaggggagataaataatggtaaggtaagggatcagctcaagatggaagagaatggggcagagaggcttttggtgatagtgtaggaggaatgaggaggaatttgcatgaaggaggaagaggatttgcctgaaggccatggcatgggaaggaaatggagaacatagatataagacatcataagtgctgataatagacttgggggtttcttgatttctgtttggagtaattggtagaaggtgaagctgttacctaagagacagtagaaaagaaagagccggctctggaaggaagttaacaaattcgattttagacttattaagtttgaggtattagcactggtctaatgtagatgtccatttagatccactggaaattttgtctagagctcaggagttgcctgggttcagaatagaaatctgggaacataagcctgaagatatttttaaagccatgaaagtaagcgagccctctcttaaggagggagtttagcgtgaaaaaaggaccaaacagagaactgcctacagagaggttggacaaaagtccatttaaaaagactgagaagaagaaatcaaagaactaagaggaaaatcagggaactgcagttgtcatagaagccaaggagtcggggagtttttagaagattttagaacaatgcgacattaagaactatgtttatagcaacttgtaaattagtcctttctttttcccccaggagctttaaattctgcccatgtgggtgggttgagggagtcttcagagtttgtagaagtagctctgggtttctgaaaaatgtgaaggtgatgtactgacctagttaataccccgtaatcctgggaggaaggaaggggctgtggctggagtatttatttcttgtcatgataggtcttgtcatgaatattaactatttactctttgaa

SEQ ID NO: 1205 - DNA, 2036 bp, Homo sapiens
tttagttgctgtatgcctcagttgccttagctacaagctgagggtggtgataatacctgcctcactgcttctcagaattgttggggaaatacatgaagtaatcttataggatgaagactcctttaaatgatcaaaatcttcacatttgataaatgattattattgccatttgtctgtttttgggtatgatattcatggctgatcttagtctatcaaatcattttccccaagttcatttatccttagaccaagattcatggcatcttacctgtgtgtctagctgggtaaatgttttatgacatggctgccactaatacagatattccaggaggtcatgtatattagaaaaacgtgtcttttgaaatagaactgaatttgaatttcagcctcatcattcactgctaaacgacctggggaatttaatctttttgtgcttcagttttctcattgggaaatggctgtgataattaaatgataaacactgtgaaaatgcttaacacactgccaggtgttatggtaggcttttaatatgtgctagttctctttccctttaaaacaagcagaatggaatccagtatttgcaacacaggttattttctttataagagatccatgaagggagtatgattaacacaaattcagtttctatttacattttgctgtagttgagaaagtgaggcacatctgtacttgttttctgataaaatcataatttcttagataaaattgccttgtattatatgccattttttttagagaactgagtattagctgtttgttgatagaaatggcacagaaagcaatttgttgtttttattttattataatttgaaatgctatattttgagtgaattttttttttgttatttacgtaggacttatatctacctatttctagaaaagtttttgaactgttcacaaaattaagcccaatagaaaacaaggcaattaaaaatgaaattgaaacaaaaatagggtaagcataaaggtatcttcagacacctgatgataagtggtataaaatggaaggacaagagctcttcttgtttgttgcatttcttgttgttcattatcatttttcattatccctgtttgagcatcccccacctccctctcttccttgcctcctcattatttggaggaatgggagacatgggagctagggaagttggtgggtaataagccacagctgaccaagaatttgcagcatgcaaatagaaagcatacattctttttgttgccttgacttttttttttttaattcacagcttcaaatattgcatctgcaaatatattgtctcttgcctggggtataacctttcttcctgtctttatttgaaatgtttctgagccaggaatgatggaatgaatgactcaatctgattacataaaaaaagattttgatacatagctttgtatttgtgaatttaaaatgactgaatttatctttaataaaagtgcctcctgagaaatgtgtttaatggaggtttatgctgttatggatatttcaacctaatagtgtaattaccatatgtcattaatcctatttctacagggaatttgtccccttgtttcttttaaagctagagggtaacaagagcaaatgtttttaactttagcacattattcattttagatgtaagttgacaagttgaagatatgaaaataagaaatctggatgatcaattttttaaaaagtggcaaccattaagctgtgttcaaaaagaatgcctcatggcatccccctcctgtgctgatattagtgtaaaacacttatttttagcttttgattttctgtgctccccaccccaaatacttttttggtaggcctcctgctgtgaccaaagtcaaataagtggaaatgagggaaggttaacatttaagtgataaatttaagagaagattacacattcagtgtttgcttgctcagtcttctgagagaaagaggtggtgtgatctgttgtttttttctcttcccttctttccattattcccatccaacattatgttataatgaaagtaatatatgttcattg

SEQ ID NO: 1206 - DNA, 1879 bp, Homo sapiens
ggaaagactttattctcaaaggcatcacagtcaggagatgctcttccaggaagcagcaaactggaccatgtaacaaacatgcagtgatcgagggcccaggaatgagcactaagtgggaggaaaggacatggaaaaatgctaaggcatggtggggcaggacaatagtctcaggtactagagaggctgaggccaagggggaaggatccctttggtctaggacttcaagtccagcctgagcaacatagtgagatcctggcaaaacaaaacaaaacaaaacaaaacaaaacaaaacaaaacaaaacaaaacactctaaattaaaaaaaatgcattgattaatttcccggctattgctttctctattaaaattagaattccttgcttgggcagccctagccaacaccttaatgatggccttgagaaagaccctgagccagaggcatccagctaatctgtatccagattcctgagccatagaaacttcaagataattaatgtctattgtttaaaaccgctaaaagtcaaacaatcaatcaatgaataaaagaaacagcagataaaaagcacaccaacatgtatagcaccaacagtggatacatggtaagatcttgatcacaaataccccaaatctgcaatgactttaaatctggctgttttaaatatacttctgcactgctaaccatttaagcagttaagattaaaaaaattttttttttgccagttaccacaatctcagccctctaagtagccagaactgacatgtgaaaagtgtctcttgaaaacactgattgtctctttttctctgattcattttccccttattgatgataagcaattttaaagacagtttgtgtgtcatttcttatcatgagaaggtgagaagagggagagttggttattattgttgaaccatctgctacaatctattgttagaatgcacactatttttaggttctagatttgcttaggtaatatatttctaccttctgtgagtcaactttcttatctcctgtgggactatatacaagattaaaaggaaaaaaccactttagacaatttgatgagtaatgtggttaggagaattcattcattcattgaatgaatacattttgagtactactatgtggctccttctgaatattaatggcttcggaaagactttattctcaaaggcattacaggcaggagatgctcttccaggaagcagcaaactggaccatataacaaacatgcagtgatcgatggcccaggaatgagtactaagtgggaggaaaggacatggaaaaatgctaagaagaaggctagaaaaagagcctgcatttgaggaaataagatgacagaaatatgaaattaattatccactgataacctagaactagatgatagcaaacattttaaagtcctaaattttcacagtgaaatgtgatattaatctatccacttccttagagacctagtgctgtatctcagcaaagctaaaccaagaacttgaaatgcttactttattcaggcacaccatgcatctcctgtttttagttaggtgcttttgaaaagatgactttcgatatatggaaaagaaggagagagtagtttattcttttttaaaaagaaaagtttcctctaaacttgatgactttaaaaatgttcttagatctttcatgagattgtgtattcaaaggtggcactcctaagcagactgtgatgtggcttcaggcaggggtacagtggcctggatacagtttgactctgacatgctgagacagtgataataccggctgtagcctgaatgtttctgtgttggaagtccactaaaaggttatttcataactgggaatgcagagtaaatgattatttcttatttctgattgttactactctttt

SEQ ID NO: 1207 - DNA, 1944 bp, Homo sapiens
tgttccttgcctaaagaggagaaaatcaccttaaaagtccaaatagtaggccagacacagtggttcatgccagcactttgggaggccaaggcagatgactgcttgagcctaggagtttgagatcagcctgggcaacatggcaaaaccctgtctctacaaaaaaaatacaaaaattagccaggtgtggtggcgcatgcctgtagttccagctagtccggaggctgaggtgggaggatcagttgagccctgctaggtcaaggttgcagtaagccataattgcaccgccgtactctagcctcggcaacagagtgagaccctgtctcaaaaaataaaataaaataaaataaaataaaataaaataaaaagagggtccaaatagttttctgtatataaactaggcttctaggcttggtgcggttgggatccattagttaatggcttaatgatgatatctcttgtaagtgatttctgaaaattggaaacaaatggaatgattcaaaactgagaaagagacaactatttatttacatgtacttctcactccgaagcccggacactggtaaagtatttcattgtggggaatgagatgcattttcactttgtactgctcagcagatgcccctatgccttctatcctaactttcccaaggataaaaagtatctaaaaattaatgtcatttcttttctctttttcccatactttttttccaaaccaccccccacccaccccaatagctttaggagtacaagtggttttggttacatggataaattgtgtagtggtgaggtctgggcttttagtgcacccatcacccaaatagtgtgcattgtacccaacaggtgatttttttgttcctcaccccttcttttattgttgacttaattttctttttcattctctcactcaacatttccttaatatactccagtccatcatccagattaaactttagaactctcttaaactaaacaaaatggcctttcaaattacttgccttcctttcaaaacccccattctgctttacttaataaatatcccttctgccatcagttctcccattacagcttattagtcttcctgtactatgctcttgctttggggtaatcaaacaatctgagccttcactgaaagaaatgagttcctggcacatgtagatacatcttgaacttctagaatattaatttaagtctagagatgtagtgtgtattgctgacagtttagggcaaatctgtctttcacaaaccactcacaggagccttgaggatctaggcctttgtttttgtaagcagtaagttatattatgttggtcattagggcctgtaattttgtttccttgacagttacgtgagactaattcaagtcacttcactgatgaagaaaactaaaaccaaaacaataaatcttgaacataatcttccacatacctgaggcaattgggacttcatattgtttttattttagcaacaatattgtttagcaacattactcaagaaaatggttcctatctttattaatgcttcctagtctgtttttctcccattatagcttcagtttttagtatgtttgttgaatgaattaatgaataactaaatgaataaaaagctattatttctttcttagatgtagtgacagtcctagaaaaagtaagacttggccaggcacgttggctcatgcctgtaatcccagcactttgggaggccaaggcaggcagatcacaaggtcatgggcttgagaccagcctggccaatatggtgaaaccccatctctactaaaaatacaaaaaaactagctgggcatggtggtgcacgcctgtagtcccaactactcaggaggctgaggcaggagaatcacttgagcccaggaaatggaggttgcagagagccaagactgtgccactgcacttcagcctgggcaatagagggagactctgtctcaaaaaaaaa

SEQ ID NO: 1208 - DNA, 2169 bp, Homo sapiens
agtgagtttccacaccaggagcatttagtctaaatgtataaggaaaaaaatgtatacttcagtaaaaaactgtgccttttctaaagcacacttatctggggttgtctacttctaattccatgggcactatttcggactataagttgtacataactgatagcaacacaaaataattcttgtttatagataagtaaataaattaagtccgaggaagggacaacctcttcctcactccaagaaaaagtcagttttgcattcattttcacattcattttcatattcctttattcaataaaataatataaaaatatatactgccataaaactggagtatatatttttgcttctttcacttctcctttaagcagttataatatttacctggttcagtcacttaatcaatgagtcgaataaaatctttagcacatgttcattttatctctatgagagtcatgattttgcccctttttgggaaaattattctttgataaatgtcgtgtctttaccagcacatcaaaaagatgctctactaaagtaaaactgaccctctgcccagcatccattcagctccattctgctctgaatcttcatatttaataaaaagtttgattaggttttcacagggtttgctgcattgaaatctgggggaaaaaatagaagtaaaaatagagactctgacagcaaaagaaagcaggatagggaaggggggaagggcatttgcatctcttaaacacttagtaaaggatttgagaattggggtaggatgggaaaaggcgggcagaggtaaaacaggataaataacagctcaaaacaattatctttgagacccgccaaaatcattagttatccccctaataaattcttttactccgcccccataccacatacactcttaaaatgtgttgctagcaagtgtttggggcttgatgacatctctggaatgttttagtcgtgtttagcatggcagcctgggctctattctgcttggaagcaaccagggaggatctgtgataagtgttgaagaaaaggacaggaaaagtggaagaggaaagaactcaagcaaattccttcttccagacctattcatcctcctctctccctctgtagcttgggcttctgaacactctcttcagtgtgttatggcagggagagcgaggcaaggagaaagacagcacaaaccccctgagctaaacccagggcctccacctctgccttcccgagtcccaacagtttccatctctgttattgatatcttcctgctgttttgtcccggccaaattgctctgtactgcctcttggtggcctttctaccaagtctgttgccatggctactacttttcctgactgacacctccaccatcagcttcatcatctatttggctacctgcttgcaggagttccttccaggcagtagagctttcattcaactccaatggactcctttaactcctctccattcctctgagcaatgtgaggaaagcttgtatggcttgagccacagtttatctttgcatttttattccctgtggcctcatccctgaaccaaatcctcatcatctcttttatgggccatgcagccatctgctaagtggattgcattaacttgtagaaacaaatagacctcaaaattctagtggcttaacataataaaaacacattttttgctacaaggttggtggagcagctctccctgacacggtctttcagagactctgactgaaggagacttgtctgtgttcagtatgtggcctccaagggctccatgggcattgagatcccagtcagttggaaagggagctgagaatggaaagcatgtatgggaatcttttataggccaggcctgcaagtggctcgcatcccatctgcataaacacaggggagaagtggggaaccctggtgtggcttctcctgagccagtaatcttgcaaggctaggtaaagtatattagtctccgtatgttattctaaaatagcatctttgtgtcctattggtgccataccagccactttaccaagtggtgagaaaaaaagaagaagaagaagtaaaagaggagacaggaaggaggcaggaagagatggtgaagcagcttaagaagcccaggtatccagtaacaggtagtgagattgaatcagtaataaagtctcccaacaaagaaaagtcccaaactgg

SEQ ID NO: 1209 - DNA, 1984 bp, Homo sapiens
gttaagaacagagagaaaataaaacacctctttgtattgacaatcgaacttacaaaatgacaacttaccaaaaaaatttacatttgaaatatagagatatcactgtaatatgtttatatcttaaagaaaatgcatacacatatacagaggcttgtatattataatttcctaaaacccaaacacattcaggcaatccaaatacattagatattagtatgtagagtttatcaatgaaactatttctataatacaacatacacgctttttttcttttatgcttatttctgtggtctagatttacaacacttaccaaaataaacaaactaaaaccaaataataaaagaaactgctgtctaatatcccttggggaatctcaacatttttatcttattcttaaccacactgctggagaattcttagaccttagatatgaagtgatatttaatgaataagaaatgctggagaaagaaaatacaacaggctggtgatatgcatacttttaatttatgttggccaaaacacaattttcccatttactgattcttttcacaccagtcacagtaaatagcacagacttttgtagataccaaaataactgatgttttactattagcacttttcaaatcattcctccttagactgtcacctttttccagctcaaaacagacttcacaactgcaagtttccactgtgtagttccaacattgcaatattttccccaaagaggtgtgaaacaggtcagtatacagagctaatagcatcacatttttatttagggggaaaaatacatgttacgaaattgttgggatagcgtaaaagaacaccagcttctgtgtttttaagcaacttgggaatccatatcttctatttagtacctgcacagtagtgtttcacagagagattggctatctctaaacagctgacaaaggaatccaaactcctcttggtatggcccacacagcccttcacaatttgtacccagtccaactttccagctcagctcccattgtccttctactatgtaccaaatcagtgttacctaaactttttcataaggcacactgaggtaaatgaacaactgggctcaagccccaggaatgaaaggataactgtctatgcagccccatcacctggtatgtcactgaggtaggggcattctacctacattctacctatgggagtgtattcatggttcctttgacgtgtcatgtaaccatcgcaagtctgcagttttgcacacactattccctttccctggaacatttttcccctccgtacgaaagaaataattcttatttttcaagactcagctcagacttcacctctgcagcacaggtgttcttgccctctgctgcctccttagccccaagaatcagaggctctcctctctgtgctcccaggggacttctcacccacagtaggtcacttctctgtcttctacactgcaagtgagccccttgagagcttacttacttttctaacttcagaggtaagcacaatgtctgacaaattgtaggtgctccattgctgttctttgaaataattcagaatttctccaaagcatgcagagaatagagaaaattcaaaaccagtctctatcaaatagggaattattctgaagcatatgtgctcaatttcacctgtggcaggacttgccatttatggattcctggagaaatgctttgatgcctccttctgaaattcaacatgcagtctaaaagagctcaagtagatgcaaacaggagcaggcaaattcccttggaccctgagcctccctccctcccagaggcaggtttagctggaggccaaacaatcacaagagtgctggtcccacccagaaatccaacaatattcagcatctaaaaacatgtcctaaagaaatcaccagcaatgcacaagcaattctgctcaaggttattaaatgtagcattatttataagagtacaaataggaaacagcctaaatgttaaacaacagagaccta

SEQ ID NO: 1210 - DNA, 3357 bp, Homo sapiens
gcagcatactataaatatgcatttgtactttgttggagtttttttccccacttgaaagttattctacaaatcactccacatcagttcttagagactgacaatggtcagattgtccagaagcaggtactgagagcaagtttggtttgcaagggttttattaatgatcaatacctgtggaaaacagggagcacagcaggattggataaagggagaaatggaactccctttgtgttccactttgtgttattgggaccgtcaaaccacacctgaagatacgacctatcagacttgttcactggtagtccaaatggcccggtctgtatgccgtttctgcaatcagtcattggaagtgtgcctcccccagaacgttgtgccgttgtgtgaagactggatgactgaggcaaaccctgaaaatcttaacagtgggaagctatctgctgacagaactcacagcagctgagacaacaggctctctcttgacaggatggggcatcacagtggaacatctggacaaaacctcaccacgtctaccgcgtctactgagttagaagggctagagctgtgctgtccaatatgatagccactagccatatatggctatttaactttaaattaatttaaatgaaataaaatttaaaaggcagccataccagtcatatttgaagtgtttaatagccaatatggctttacagagaatttctgtcatcaagcaaaattccgttggaatgagtgctgcagaataaatagatgtctaaaacagtgtgatgtttgaaaaaattcggtggttatagatcatccatgagatagtatctgcacctaatcttgataactgaggattgtttgcattttttaccatttgaaagttgtatttacaaagcagactctaagaaccacatgttaggtatgcttcatgaattcttttatggtttagtgttgaaccaaaacatagatgagtgctcctaaagtaaatattttctatttttagaattctctgaagagtttttgaattttaagtatgtaaaaataaatcttgtaatgccactttaaagtgttattgcatttacttcaaactgctagcattgtaaatttcagtaccatacaatttcatttgagagatgtgtcttgtatgaaaaattgtgttgcacttttatttgcctatcaacagccactcagttcctaaatttttcagtgagaattaaaaaaattgaatctctggaatattatgtttttttgagagcaaatcatctaagtgttagagttgaagagtataaatgtggactatttttaagtaaattaaaagtgaggctttggtcgctcttttaaatgtgaaaatagctctgtctgctggaaacgtgtcaggtaattaactttctttccctgacactgctcattgagtaatgagcagtgacaccacctatatatttacaaagattgtgacttatatacgtgcatacccctccatatgattattgaataccctcgctgcttccttttgggtacagggcctcccgaaagcctttctgaagcttctttttttttccaccttccgttctctttaattcctcaggccattatttgctaacatttacaaaagtatctgcagtaaatttgttaaggaaatggagaatccaactaagctacactacagatttctttactacaaaactattagacttattattattgtaatgtgttttcaagtctctaaaagcactacagtctgtaaaatctcccaaatgtatctaaccacggagtcatttttgaggaatatctggaattactactacacagtcaaacctactgtgggattgctggcatgaaatatctggccttcctgctacgaatccttctccagttttatgccccaacatagaaatgtatggtttgtacctcagcttttgcagattttgtagcttaagatgtgtaaaaagtaatacagaaagtaggaaagggcagggctgattagatcacatggtgatggcaaagtatacacctgcaggtgcacctgcttatgagtcagcaggaaacaaaacagccagcaacaaaaaataatctggttgattgtttaacaattgaagttgtaattagatttataattgaatttttggtatagtctagagtctggaaaatcagtgtatcccaactaatcttttcctcagcatgatctgttccagttcattgctaaccatgttcaaaagtctgtgttttttaaacacaaatttgaacaaacctcttaaacagccttctctaaccagtcccttgggtgatttttccatttcagtgacagaatagaaaatgcaattttatcttggaaaaaaatgataaagtgacagtttttatgataatacagatacgcacattttcaagcaataggctgaaaagataatgtgctttaggcaattatttctagaatacatctcattgaaatttttcacctgctccacaaacacacttaagttgttaccatggtatctctttgaaagtctctgtcatttcaatattccaagaaattggaattacaattcttatgtaattggaattacataagacaattacatattgtcttatgtaattactgatagcaaccccttttactctcaaaagagtcttggttggtctgtgtattaggtggtaaggtggtattaggtctaggtggtatggtggtcctatttagagtcagactaagatttcttgatatatttgaccatggaatccatgtgatattcagtcaagaggtgttcttggctgagttatcttttcaaaattaatatgttcagtaaactctagcccctcagaataggattgtatttggagatagtcttttaaaagccaatgaagttgaaatgaaggcattggggcatttcccaatcaaccatgactggtgttctaataaaaagagattaggatacagacagacttgggggggccatgtgaagcacgaacaaaatatggttatctacaaggccaggagagagccccagaaagaaaccacccctgccaataccttcatcttgaacttatagcctccagaattttgaagacataaatttctattgttttaagcatctcactcagtattgttctgttatggcaaccctagcaaactaatacaaaaacaaacaaacaaacagcttctttgactttatcatataaagtacagaagaaagatttacaatttttcagcatgctcctattttcaccatcttctagaagaaaaacaaagaaatgctgactgtagcaactattagatgtttcactagtctctgttcctgattaggtgtaagtaacctgttttggttaatgctttgatattcatttggacaagttagtataacgagtaagagcctagcaaactac

SEQ ID NO: 1211 - DNA, 2455 bp, Homo sapiens
atcactagctacatggcttcaggaaaagcacttaaacactgagtctcagtttcttcacccatgaaatgggtaataatacctactgtggtaggcaaagcaacggctcccaaagatgttcacattttaatccccagaatgggttaatatgtgactttacaggctaaaggaactttgcagatgtgatacagttaaggatacaggggaccagtgtaatcacagtggtcctcataagagggagaaaaggaggctcagagaagacgtggcaatggaagcagaggtcaaagaacaagagatgtggagatgctatgttgtgagctttaaaaatgagggaaggaactgtaagccacggaatacaggcaacctgtagaagctgaaagaggcaaagaaacaaatttgcccctagatcctccagaagcctctgccaaaaccttgattttagcccagtgaaatccatttctaacctctaaggctatacggtaataaatttaggttgttttaggccactaaacttgtggtaattttttgcagcagcaataggaaactaacatacctttttacagagctatcatgagattaaaagtattcttttaattatggcaacatttattaatagaaaggctatttttaaaaatgattctgagaaatgagttacctataaataaactatctctgtaagccaaaaatgttcatattcaatcattccaattttcacaagtcttaactacagggttcatttttgtgtatccagttctccagatgtggaggagatttgcttctcaaatgttcccacagggttaaataaattttttaaatattttgtttcctgacttactgaccttgaagtctgcattcaaataagacatttggccaagaaaactgaatgacctctgtgaattcttcagtttttatcagaaggacgcagacccaaagtttctttctttttgtagtgaaggtttgccaagttttccttgaaaaattaccttagttttgtccaagaagccagtatctctcaaactccacgagagttcatgtgaactctagcaagatgcagtaaaatatccattataacatctgcctatacataatttttccattccctagtctcatttgaagcatcagttggctcatttcccatctggaccttatagtcagttatcaacaatgccctcccttgccctagacccctcttctctagaccttctactgtactttattgccagtcccagctctggagaaactcccctgcctaccagttgggcaccttctttctgcccagagagctttaccaatcttagcctcataactcaccatttggatatacggtccaccataaaatcagactaccatcagcaagacccacagagcttagctgtttatcttgtcttgtgtttttctttcattaattttccatagcaggtgccacaactattcaaaatcatttctcctctactaagcccttaaacattcactccatcctcattctctcagcaaatacatttacctctgagttttcactcttaaggttaggacaatctagcaagctctttcccttctttgtactctgcctgaaaaaggcatggctggtcaaggccttcttcctttcaactttctgacctcactctcctctcacacctccactaaccacgttttctctcttctacaccattatgttcctttacatttaccattttactgagcctataaatgtcctcaagttttttccgttcttcaatcacctttacctcttcctttctcaaaaatatctaaatttattgcctctacttctttttctgcagctaatatttattaaatgtttcttgtgggtccaagactgagctaagttttataggcattatcacatttattcctcctgaggtaggtactgtcataagttcactggtaaaaatgaggaaagtgacttggaaagtttcaggaactcatcagaaagagctagtaaatgacaggatgtagaactggacccagaccagctaactgcaaatgactgtgctaaccacccagctacactgtctcttccctgattgcccttttccttctcaaccccttgtggtctgaccctgctcttcccactctgctgaaactgttccattaatgaattctttattccaaaagccagtaggttctcatcaggtttttcctggttctcattgaaatggccatttgctcacctgactttagggaggctgcagcctatgatttccttcttctctgatttctctaactctgcctcttctagatctttttcctgctcaggtctgttattttcttctttatttttatattcttgccttttactggcagccactcccaataattcaaaacccagccctatttaaaggactcctttagtaattcagcagcaatttgttgaggatttccccttctggtcctgaaatgtttaagctgacaaacatggaagctattccaggacttggct

SEQ ID NO: 1212 - DNA, 2102 bp, Homo sapiens
tctttctctgaatctgtgtccagcatcatgaactacgcaatgaatattctttgcattcagatcatatggtttatcttttcatatattccacatactgctcaaaattgtgctcttttgcttcatttttagcatgatgttatacattttttgttttcccctaaagtttccaattacttttcttttttctattgtgaaaaccataaaaacggtattcagcgtgccattagtgctgctggactcctcagttcttcatctgttgcttcaaacctgttgtattgtttttcctgaatactttttactctggaattcagatttcatcttcaagtttgggcatattactttctgtaattaaagtttatctcaggactgctttttcttaatgatttgtttacgttatttgaccactggttcagttccaccatttctagcatgtggtctcttcctctttcttgacctccacctttggttggctagagtaattaatcaattaagtgccttagaattggttcaggggaagtaaaactttggaaaactaattgtctgaaaagacttttattttttctttacacatgatagtttgctgagtatagaattcctggtcaaattgttttccagcattttaattactgcattgttttttacttgttattgatgagaatagcattgccagtcagataatttttcttttgcagattacttgtttttccatctctgaaagcttttaagcttttatctctatcttttattgtctagtatagttctttacatttattctgcccactggtcccttttaatctaaacatgtaagtctctccagctcccagatgtttttcttttatatctttaatttcctttcttccatttttctcttacctcagaacttgtgcaataaggaagtattcagttgttgaacctctttgatttattgtatatctttttcacccttgtttcattatgtctgtctttttgctctatgttctagcaattttttaaattttgcaaatataggtgaaatgttatatccttatgattttatttttatattgtgtttgttattctattaagattcatttcaatataaggtataaattggaaacccactcttttttcccaaatgtctagccgtttccaggtggtctcttccctattgatttgaaatgatacctttatcatgtaacacattctgtgtctatttttttaatttctgggttttttttccttttgtctggctctttatgagccgtatcttaccattgtgattattgtagtttcataatttttttttctagagaagagaaggtttggttaaacttttgagatgtttatttattttcccacgtcaacaatcatggactatcatgttatgtttatgagtggctgagtcatatctcctgaggaaaacatagcaccattgagtgctacagcatcctatagagaacttcagtttttggtcatactgttaagacctcttggtttcacagccccacaagccctctttgaagtgacctatccagtagggctagacctttctctccccctgccttctcccctcccctaatttttctggtctcctgcaatttttttttaaacattagaatcagcatgcttaattctacacacaaacacaaaaatcctattggcattttattgggattacatcatatgtgtagattatctaaggaagaattgacattttgggaattggttgtcttcctatccgagaatgtggaatgtttttccatgtcttcaatcttttgtgttacttgggagcattttaaagttttcttcgtttattttaaagcagttaaaattcattttttttcagttcacgtgactaatcaattctaccaggaccgtctattaaataatctgtcctaattaaggttctggggtttttccctatacaaaattgcagcaactattgtacttaagtttgtttctgaactcagttctgttctctggatctgcatgggccaatactattctatttttataactaaggatttaatacctacttaggctagccccttctcattactcttctttcaaacattcagtatattaaaagctgttataatacttcttactctgttttagaggtg

SEQ ID NO: 1213 - DNA, 11965 bp, Homo sapiens
aatggcataatgaattaaatgtccacaataaattagagctattaggatattaaatctatcttgtactttcaaagctgagcatagtgactggtaaatagttgacatttaatagacattaatcgaattaaactgcatttatgctttcaacatttagctctggctactgcccctactgatatgagataatgaatcttccaacttagttgcactctttaaaatcaagaataaaggctgttaagaacttaaagattaatattataaacgtttatatcattattaaaaatatcttcagttatgaacatgtagatctaagtggaatgtagaccttaatggagtttaagtgatgggaaagattcttgacagaccagttaagatgtgcctgcagatgttgcgaactgaatacaagagaaacaagtgtcacataaatttcagtaaaaggaagaacttgcctatagaaaggaaggttttagggagaagagaatgcgaaggagaagaagagcttcagaagttggggagggagattgttatagtggggacaatgaagatagaggacacttgggttctagttcaatttttagcttaaaactagctcttcacattggactcttctttcaagtccagggggttggactaaatcatgattttacaaacttcagtcatctgggaaccatcttgattttttctatatctgagaaccatgttgttgtgccgaatctctattaacctcaatagggaaggctcctggttcaagatgctaaagaagagacccaaagccagcaaatgagacatgtagttttattagggacttatgtacgggggagagagtccagcggcagtggactagacaggagaacaactttgcatacagtacagtgatggcaggctggacaatgtatccgcctttcatacagtgcagtggtgatggaatagacaaaataactgcaaggcccaatggtaatgggctggagagaaaaactgcaaccacctgcaaacagcatgcagtttataatgtatttccacttgacactttcctcctaatgacttccacctggcaatcttcatttaacccaaaactcagggcatcaatcctctgtatggcccatgttccatgggacaagctgggggctcaaatgttcctcatagacaagaaatgaatctctgggttgtccactcccatattccctagctcagaacacacatttaggtgcatctgccatacagggtcattctaagggtatgcttaagttattgccatcaggtgtgtttatcctacaaccatgacctattatttacttaatattttcttcaaattgattcacttgaatcactgggagggtggaaaaagatggccaaacagaagccacttccaatagtcctcccctcagagaatgactgaaccaaattgaacagctatccacaaaatcgaccaattatccacacaaaaaagcaccttcccaagaaccaaaaatgaggtgagttatcatagtacctggttttaagttcatatccctgaaaaaagcactgaagagggtagggaagacagtcttgaattgccttctccatcccctggaagcagccacgtggtgtgggggagaatctttgtgctttgcagagggaaaacatagatcgtaggacttcgcgtaggaactcagtgctgccctgtcattgcagaaagcaacactgggcagaacgcaaccagccaccacagagggtgcttttagaccagccctagctagaggaaattgcctaccccagcagtcagaacccaagttctgtaaagcctttccactgtgggccaaagcgctctggagtcctaaataaacttgaaaggcaatctaggccacaagaactgcaattcctgagcaagtcctggtgctgtactgggctcaaagccagtggacctgggtttggggggcacatggcccactgagacaccaaacagagcagccaagggagtgtttatgtcactgcccgccaaccccgggcagtgcagctttcatcttcaggaaagacttctctccacttgaggagaggagagggaagagtaaagaggactttgtcttgcagcttaggtaccagctcaaccacagtgaggtagaggaccaaaggggcttctggggtccccaattccaggccgtggctcttgaacagcatttctgaacctgccttggaccagaggggaccccactcccctgaagacagtgtaacaggcctggaagcatgattcaccacaagctgaccgtagagacagaacttgggccttgaatgaacattggcaataggcagtaaatgttgtgggcctgggacaatggtgactatggggacagaatccttctgcttaacaaaaggggaaggaagagtgggaggggctttgtcttgcagcttgcatgccaggtcagccatagtagaatagagcaccaggtaaatttgtaaagtttctaactccatgccctggctcccagactatttctctggacatgcttccctgaagagaaggacacaagcttggctggcttcaccacctgcagatggtagaaccctagagttttgagtaaacgtaggcactagccaggcagttactgtgttcctcaggcaaggcccattgtgctgagtttagctctgacccagcatagtcccagtggtggtggccacaggggtgcttgtgtcacccctcccccagctccaggcagctcagcacagagagagcctctgtcttttgggggagaaagtaagcaaagaaaacaagagtatctgcctggtaatccagaaaattcttcaggattttatccaagacaatcaaggcagtacctctatgagtctgcaagaaccacagcattagtaggcttgcagtgcccctaatgcagatatggttgcggtgagcaaacacttagatcacaacacccaagtcccttcaaatacctataaggctttcccaggaaaggcaggtatgatatgattaggctttgtgtccccacctaaatctcattttgaattgtaatccccataatccccaagtgtcaagggagagaccaggtggaggtaattgaatcatgggggtggtctcccctatgctgttctcctgataatgggtgagttctcatgagatcacatggttttataaggtgcttttcccccttggctcagtacttctccttcctgccaccttgtgaagacagtgccttccttcaccttcaccttccaccacgattgtaagtttctggaggcctccccagccatgctgaactatgagtcaattaaatctctttccattataaattacccagtcttaggtagttctttatagcagtatgaaaacaggctaatacagggtacaaacaagcccagactgcaaagcctacaataaatacctaactcttcaatgaacagacactgatgaacatccacaagcataaagatcacccaggaaaacctgaccccaacagttgaaataaataagcaccagtgaccaatcctggagtgacagagatatatgatctttcagacagagaattcaaaacaactgttttgaggaaactcagtgaaatgtaagataacacaaggaagaaattcagaatcctatcagataaatttaacaaagaaattgaaataattaaaaagaatcaaacagaaactctgaagtagaaaaataaaactgacatactgaagaatgcatcatggtcttttaatagcagaattgatcaagcagaagaaagaaatagtgagcttcaagacaggctatttgaaaatacacagtcgaaggaaacaaaagaaagaagaattattctcagcaaactgtcgcaaggacaaaaaaccaaacaccatatgttctcactcataggtgggaattgaacaatgagaacacatggacacaggaaggggaacatcacacaccggggactgttgtggggtggggggaggggggagggatagcattaggagatatacctaatgctaaatgacgagttaatggatgcagcacaccaacatggcacatgtatacatatgtaacaaacctgcatgttgtgcacatgtaccctaaaagtataataataataataataaaaattggaaaaaaagaaagtagaattttaaaaaaaaagcatgcctataagatctagaaaatagcctcaaatgagcaaatctaagagtgattgtccttaaagaggacatagagagggataggagtagaaattttgttcaaatggatagtaacagaaagcttcccaaaacttagaggaagatatcaatattcaagtacaagaaagttacagcacacaaagaagactgaacccaaaaagactacctcaaggcatttaaaaatgaaactcccaaagatcaaggataaagaaagggttataaaagcagaaagaaagagagagagagagagagagagagagagagagagagagagaaaatggttctctaatacatctatcagcccacttcttgggggaaccttacaggacgggtgagagtgacatgacatatttaaagtggtgaatggaaaaacaaagtaacttggagtaatatatccagtgaaaatattcttcaaacatgaagaagaaatactttcccagacaaacaaaagctaaaggatttcaacaccagacctgtcttacaagaaatgctaaagagagttcttcaatctgaaagaaaaagacattaatgagctacaagaaatcatctaaaggtataaaactcactggtaatactatgcacaccaaataacagaatattataacactgaaattgtggtgtataaactactcatatcttgaatagtgatatggtttggctgtgccaccacccaaatcttatcttgaattgtagttcccataatccccatgtgttgtggaagggacccagtgagaggtagtaattgaatcatgggggcagttaccctcatgctgctgttctcatgatagtgagtgagttctcacgtgatctgatggttttgtaaggggctttcccccctttgctcagcacttctccttgttgcctccatgtaaagaaggacgcgcttgcttccccttccaccataattgcaagtttcctgaggcctccccagccatgctgaactgtgagtcaattacgcttctttcctttataaattacccagtctcatgtatgtgtttattagcagtgtgagaatggactaatacaagtagaaagattaaaagatgggccaatcataaataataactacagcaacttttaaaaatagacagtaaaatgagatataaatagaaacaacaaaaagtttaaaagttgaaggataaagttagagttttattagctttatatttacctatttgttagtttgcttatgcagtcactgttaagttgtcatcagtttaatataatgagttataagatagcatgtgcaagcttcatggtaacctcagataaaaaaaatcatacaacagatacacaaaaaataaaaagcaacaaattaaaacatatcatcagagaaaatcaccttacagaaagaaaagaaagaaggaagacaagaccacaaaacaaccggaaaacaaataacacaatggcaagggtaagtccttatttatcaataataattttgaatgtaaatggactaaactcctgaaagagatagtggctaaatgaataaaaaaaataaaaacaagacccagtgatctgtgtggcctgtaagaaacacactttacttataaagacgacatggactgaacataaaaggatggaaatagatattccacgcaaatggaaaccaaaaaaagagcaggaatagctatatttacatcagacacaatagattttaacataaaaactataaacagagacaaagaaggccattatataatgataaaggagttaattcagcaagaaggcacaataatttaaacatatatgcatgcaatatttgagcacccagatttacaaagcaaatattagagagagagaaaaaaaaaagagaaagagagagagagagactccagtacaataatagctggagacttcaacatcccacttccagcactggatagatcattcagacagaaaatcaacaaagaaacattgggcttattctgcactatagacctaatggatctaatagatatttacagaacatttcatccaatggttgcagaatacatattcttctcctcagcacattaatcattctcaaggatagaccatatgttaggtcacaaaatgagtcttaaaacattcaaaaaaattgaaataatatcaagtatcctctctgaccacaatgggataaaactaaacattaataaagagagaactttttgaaactatagaaacacctagaaattaaacaatacgctcctgaatgaccagtggatcaatgaagaaatcaggaaggaaatttaaaaacttcttgagaccaatgaaaatggaaacacaacataccaaaatttatgggatactttgaaagcagtactaagaagaaagtttatagctataagtgcctacatcaaaatagtaaaaagacttcaaataacctaacaatgcatctgaagaaactagaaaagcaagagcaaaccaaacctaaaattagtggaagataacaaataataaagatcagatcagaaataagtgaaattgaaatcttaaaaataccaaagatcagcaaaatgaaaagttagtttttctgaaaacataaacaagagcatcaacaaacctttaaccagactaagaaaaaaaagagagaagacctaagtaaaaaaaaatcagaggtgaaaaaggagatgttacaaccaattccacagaaaatcaaagaatcattagaggctactattagcaactatctgcaaataaattggaaaacctagaagaaatggataaattcctagacacttacaacctactaaggttgaaccatgaagaatccaaagcctgaacaaataacaagtaatgatattgatacagtaataaaatgtctcccagcaaaaatctgagacctaataaagttcactgttgaaccttagcaaacatttaaagaactaacaccaatcctattcaaatgattctgaaaatatggaggaggagggaatacttccaaactgattctacaaggccaatattaccctgataccaaaaccagaaaaagacacatcaaaaaatgaaaactacaggccaatgttcctgatgaatattgatgcaaaattcccaacaaaataatagcaaactaaattcaagaacacattaaaaatttcattcatcatgatcaagtgggatttatcccagagatgcaaggataattcaacatatgcaagtcaattaatataatacatcatgtcaatggaatgaaggaggagaaaccatacgatcatttctaatgctgaaaaagcatttgataaaattcaacatcccttcataataaaaaccctaataatactgactatagacgaaacatacctcaacataataaaagccaaacataacagacccacagatggtatcacattgaatgaggaaaaatggaaagcctttcctctaagatctggaacacaacaaagatgcccactgtcaccactgttatttaatatagtactggaagtcctagctagagcaatgagagaagagaaagaaataaagggcatccaaattggtagagaagaagtcaaattatccttgttttcagatgatatgatcttatattgggaaaaacctaaagactttatttaaagaaaacaattagaatcaataaattcagcaaagttgtaggatacaaaatcaacatataaaaatctgaagcatttctacatgccaacggcatacaacctgaaaaagacatcaagaatgtaatcccatttacaatagctataaataaaataaaatacataggaattaacttaaccaaggaagtgaaagatttctacaatgaaaactatacaacattaattaaagacatgaaaaaggacacacaaaaaatggaaagatattccatgttcatggattagaagaatcagtattgtttaaatgtccatgctacccaaagcaatttatagattcagtgcaatccctattaaaaaaatgacattcctcaaagaaatagaaaaaaaatcataatatttatatagactttctaaagactcagaatagccaaagacatcctgagtaaaaagaacaaacctagagtaatcacattatttgtctttaaattattctagagagctactgtaatcaaaacgacatggtactggcttaaaatagatacactgaccaatgggaaagaatagaaagcccagaaacaaatccatacacctatagcaaactcattttcaacaaaggttccaaaaggatacactggggaaaggacattctcttcaataaatggtgctgggaaaactgaatgcctgtatgccaaagaataaaaccagacccttatcccttgccaggtacaaaaataaaatcaaaatggattaaatacttaaatctaagcctttaaaccatgaaactattaaaacattagggaaactctctaggacattgaactgggcaatgatttctttaataatactgcacaagcacaggcaaccaaaacaaaaatggacaagtgagatcacatcaagttaaaaaccttctgcatagcataggaaacaatcaacaaagtgaagagacaaaccacagaatgggtgaaaatatctgcaaactacccatctgacaagcgattaataaccagaatatataaggagttcagataactcaataggaaacagatctaataatctgatttacaaaatgagcaaaagctctgaatagacattttttaaaagaagacatacaaatgacaaacaggcatatgaaaaggtgctaaacatcactgatcatcagaaaaatccaaatgaaaactacaatgagatcatctcaccccagttaaaatggcttatatccaaaagacaggcacaatatcaaatgctggtgaggatgtgggaaaaaaggcaatgctcgtacaccgttggcaagaatgtaaattagtacaactaccatggagaacagtttggaggtttctcaaaaaactaaaaatagaaaaaaggcaatgctcgtacactgttggtgagaatgtaaattagtacaactaccatggagaacagtttggaggtttctcaaaaaactaaaaatagagctaccatatgatccagcaatcccactgctaggcatatacctaaaggaaaggaaatcagtatactgatgacatatcttgtactcacatgtttgttgcagcactgttcacaatagccaacatttggaagcaactgctgtgtccatcagcaaacaaatggataaagaaaaggtggtccatatacacaatggaatagtattcagccataaaaagaatgagattctgtcatttgtaacaacatggatagaactggaggacgttatgttaagtgaaataagccaggaacagaaagataaacttcacatgccctcacttatttgtgggagctaaaaattagaacaactgaactaatggagatagtaggatgatggttaccagagtctgggaaaggtagtgaggggtggggagtggggatggttaacaggtacaaaaatataattagatataatgaataaaatctagtatttgatagcacaacagggtgactacagtcaacaataatttattgtacattttgaaataactaaaagaatataattggattgtttgtacacacaaaaggataaccacctgaggtgatgaatacctcttttatcctcatgtgatttttatgcatagtatacctttataaaagtatctcatgtaccccatgaatgtatagacctactatgtacccacaaaaattaaaaattaaaaagaaatggagtcactttaactcaaataaatttgttatcaaaggaaactaggtgtcattaccataaggagaaaaccagaatccgttgttataaatacaagaaaactgtgaaaataaacaaaagcagagctatcttagctagacaagaaagattccagcctgaatctgccttcactttgataaaaagggagattgtctggtattagagagatattagagaaaaacagcatcaaactaagattcctccttcatgtagtcagaatatatcgaaagaaaattgaaaaggcagtgacttcctcactcactcattgtcagttattgccctgcccccgcccctatcaggctcctttggactctcagcaatggtacattcagtcacacttagcatatggcgaacagagcaaaagtgaaaagtttgtttcaaaagtcacaggccagggtatagtataacaaaatacttatggttacataatagttttgtttcctaaagagaatttcatctgacaattttaagaaactgtgtttgcagaatctctgaactatctcggtaatcaattagaaaatagcaatcaaaatacctcacttttggagcttgcttcccacctcccccctacccctgcccccctccaaaaaaaagcactttatcccatttgataatctgtgggtgagaagaaatgtatatcaactctggaacaaatctgagtaagttgaaatccaaattcctctctctctaggtctattgccttaaaaaatcatttaatgtcatttatttctatttcatcatttgaaaaaggagattaataagccttactaattgttgtaagaattagaagtaatgcatgtaaagaaactaacacctaatgtgattttaaaacttacagactctctgctcttcccatttgacagacagacacatcttctcatacagggacagcggaagcatcgttgagacacatgctgaagtgatggcaatgtggatgtcgttgccatcactgacccctttgttaacatcaagtacattgtctatgtgttctagtatgattccaccaaataacaagttcaacggcatagccaagactgagaaccaaaaggttgttataaatgaaaaacccatttccatcttctaaaagtgagatcctgacatgaaatggggtaattcttgtaatgaatttgttgtggaatctactgtgtcttcattttcttgtaaaagtctgacttcatatgaagggtggagccaatagggtcatcatctttgtcccgtctgctgatgtccccatatttatgagcatgaatgatgagaagtgtgacaactccctcaagattgtcagcaattcctcctgcactaccaagtgcttagccctcctggccaatgtcatcaataacaattttggcatcacggagagactcaagatcacaatccatgccatcactgccaccaagaagactgggaaggcctctctgggaaactgtgttgtgacagccatgaggctagccagaacttcatgcctgcctctactgatgcttccaaggctgtaggcaaggtcatctctgagctgaatggaaagctcagtggcatggccttctgtgtccccatccccaggctgtgtctccagctttctatggactgtccagagaaagctgccaaatgtgatgactccaagaaggtgatgaagcagacattggatattctcctaaagggcatcctgggctacaccgaggacctggttgtctcctagactctaacagtgacacctactcttctaccttccatgctgggactggcattgccctaacaaccactttgactagttcatttcctggtatgacaatgaatttggctacagtagcaaggtggcagactttatggaccacatgtcctccaaggagtgagagcctcctggaccactagcctcagttagaggataagaaaaagagagagaccctcaggtgctggggagtccttgacccagttcaatcccccaacacactgtgaactgctcatagaaagatgtgcctcaaaactttaattagaccttacagtcacagaggtctgcttccatctcagtggagcaaatagactttaataattggactttaaatgaaattgaaactcactcaccatatgtttaatgcatctcatctaa

SEQ ID NO: 1214 - DNA, 3463 bp, Homo sapiens
acacatcagtgcaggactgagggaaggcttttagaagatgtgggactccaccttttcaaagggtcaaagggcagacaatttcacaataaagggcagagagacttggacctcaaggttatgggagaaaacctgctatctgatcagagtgcaaattgctccaaggattggctgtcaatcacagaagaataagtagaccattatattttactgtctgctccttgcatagactaaattagagcagtttgtgtactttttatcactttctttgtactttatgttgttaaaaaaatgaatatggcatatatccagttttgccatcagagcttcaaatacaaagaatattgacagaatatttttaataatttttttaaaaatcttccctggctatataagagataaagctgttttgttgaaccatacaaatagaaattacaggaattagccataaaaatatggatactgcctacttaaagcttacatatttttacaagtaaatgatagagcagggtttaaatgcaggtctgtccaaactcataccgcatagaaaattgtgaaaattaaatacaacgaactctaaaaactaacttagggcagtgcctggcatgcaataagcacccaataaagaacacgcacacgcacatttcatttctgcatttgtccacagggccctactcactgtatactccgcactccatggactttaaatacagctacctaagtgacacagtagcccagcagctggttaaacatcagcaagtagaaatgacagaatggacaaagaggctatagagaaaggaaggaatagtttttaaggtgtgctacctggagaaaaagaaggctctgtgaggtagcctagatgaggatgggggaaaagttctttaaaaaagacaacaggtaagggaaatggtactggcttagtggcaagtaggaagattataggatgcagtgtgcgactgagttctgccagccactagaccttactaacagcctgtctctgagtctctttttctgcagatggaggtcataggtgaaaaaaggatatgtcgaaaccctgagtagatgtacgacagaagtagaaacaaagtctcctctttgtttgccctgggatgtagccatatttccttatgaccatatcccctgtctggcttgcagactactgtacagtttttgcattttttcttcagaaatgactcacaaatgctatattattttaccttcccaaattgctttccataaaccaaaaaaaggggggcttggagtgatattataaacatggcacatctgtttttaataaatgaagaagtattataaaatttttactttggggaaatatccagaattttttcctgaagaaaaattgtatccatctggtcccatgagagctggtttttacattaaggaatatttgttggttgggtgattggagagtgggagtggggaaaagggggaagttgttagatccaacacttatcgttaagtggagttagtttctaaaaatgtagcatccagaaactggtgagtaatccttcttcgtagtgcaatattatgtcaccagatctgctgagctaatgcacaataaaattaatcctccatttctgcaaatgctggtgatatggcaatcacagatgtgctgaaatagaagtgttcatgccaggcagagttcacgagccacagatctagccaattgtcaaatttccggcccacacttcactccaaacccacgctatctgaagggaggaggaagtggctgaagattcacttatcagctttccaaccctatctcatctctttctccagagttgttattgcacatttttgccattattttacaatttccagccaacttggcaacatactatttatgaagacagtatgtggtagggctcgggcaggagaagtgaaagtaggtaagggcaaagaactgacattcatgggcatgggcattaaatggggccttctagatttaaatttcccaaaaaccttgtggagctggtgttacacttccaattttagactggaagaaactgcccagtaagcataccaaaatcagtacaaccccaagctctttccattataccatgttgatccagtcagcatgtctatgcttacattcttcttctgaatgatccctactgatttccaaaaaggaagcactaggtgaaaggaatttagggtcaatctagtttaataacccagcccaacgaatggcaaagtaaagcaaaagttacccttaactcactggtccagtccattgtggccgttcatgactatactgcgatatcaatggggatcttcttttcagaatctggccacatgctcatggaatcaacaccaagcccctcaaaactccaggaaagagattctgattgattaagcttggatcacaagcccacttcctggctagagaaagacagaatcccttgaccaatataacaccatatgccaaggagaattgggttgctgttaccaaaaagccaaaataaaagatagccactagaatggtacttttagaaacctgcagtcaccccgtctgttgtttgaaatttgtattacctctccctctccaacaggaaaatgggaaactaaaccccatgagggcagagccattgtctgttttgttcctctctcaaaaccaaacattagcacggagcctggtacgtgtagggcatgtaatagcacatgtctgctatatgaatggaccagtcaagatctacatgttgcctgaaagtctcatcatgagaaactaaatgaattaactttggtgcctacttcaaaccaagtgacttggaggtctcccgtgaaacttgttcttctttcagttgaatctcaaaatttatcatgactcctagcaggccttagcaacagtgaggaaaaagctgcccagcagtagctttagcccttctgcagaaacaacactcaccaattctgagtgcttggatggccaaaatcaccccagtcagatgagctttagcagttctcctttcactgaaaaatcattaaacatcctttattttttttttttcttttttttttttttgagacggagtcttgctctgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccacattctttatttttaaataagaagcttagctaccatctacagtgcaatatctctgtttcatgtatttatgacgattttagcttgtgtctgaatgtcatcgaggaaaacctcttttaattgggaggttgatacacttt

SEQ ID NO: 1215 - DNA, 2081 bp, Homo sapiens
gggatctgtaatctcaaaaaattctctagtcaatatctttgtctttatcattttcttctttatgtattttttgagaaaatctctctaaaaataaatacatgctgtgagaaactcaacagaactttaaattatttccttcttaagtacaagaatagttactgaggttcgagcatgtctttggccctagactgggtgagatgcccagctctccactctgcatgtcccaagcagctctggtctatatggatttttatttgagtcagagggaagtcataaaacaacaccctgtaatctccacaataggcacccaaattcatgaccgttatcacaatcttattcctgtgaccttacagcttttgaatcacaagagaaccaatttgctcagttggagtcacatgatgatatggggaaaaccatttatgaacaatctctacaggcttccatctaaaacattctggacactgaagaaaaattaatcaaatcttgtagactcgttgagctggaaacttaggaataatttagtccaacagttttcaaatttgaacatttttccctcaaataaaagcttcagaagaaatccagtaaatgataaatggatcttttttgactgaaataagattgatgaccgggaaacccacccatgaacccctcaggtaacctcaagagtagtatccagggccgggcccgatggcttacgcctgtaatcccagcacttttgggaagccgaggcaggcgaatcatgaggtcaggagttcgagaccagtctggccaaaatggtgaaaccctgtctctactaaaaatacaaaaaaattagctgggtttggtggcggacacctgtaatcccagctactcaggaggctgatgcaggagaattgcttgaaccctggaggcagaaggctgatccaggcgaatctcttgaaccctggaggcagaggttgcagtgagctgagatcacgccactgcactgcagccggggcaacagtgcgagactccatctcaaaaaaaaccaaaaccaaaaacaaacaaacaaaaaaacaatgaatagtatccaggagcacaacttgcaaacaatcaagtctcacctttattttgtagagaggaacctgaagtgcagagaagggaagcaagaaagtgacctacccagggtcactctgaggggacggcaaaagagtgagcacccacatttcttggcctagccctgtattcttccccacggccctctttccatctgctgctgagtcgaagcactttatagcagagcagaggactctgcctggcccaggtggagctgggaagggagaaagcctccatcaactcaactttcccccaggacacagagcagccctgctggcatgttatcactaatatacaaaatgtgaaattgtaaggaattgtttgccaattttcttatctcaactggcacagaagcaggcttgttggagagttatgaggtgttagagtattgttgtttatccaccgcacatccctcggctgttctcacggagagactcacggaagcctgcacacataaattcacataaattaccttcacaaaatgtcaaaatcaaaagtagatttttattttgggtatatgccttgagactgttaaccccttcatgggggtagaggtatcagcatgagaaaacacagttgacatctttgactacacgcaggccacagggactaactcctgatcttccttcctattcccatcgctatcccatctgcaacagagtcatcgttcttgttaacaagccatagacttttctaagttccctgtctgtgcacaaatactgttctagagacaagattttttaattctgtggttaccgtaatttcattctttatttaactaaattgtaattaactaactgagagttcagaagagatacacaaccattctgggcctcagtttccttacttgtaaaaggtggatgctacagtttgaaagtctgtgtcttcttcaagatttatattgaaacataatcccctaaatgcaatattaagaggtgaggcctgtaggaggtgattaggctataagggctctgttctcatgaatgggattagtgccttataaaaaa

SEQ ID NO: 1216 - DNA, 1978 bp, Homo sapiens
gatttcacctcctcctctgcctttgtcatgtgcctaattcttacttgttctcaaatgcattgtaatttttgatggtcactaagccccatttctttccccatattctcatctgaactctaatgaggagatagaatatagacagtttaaggcttaaagaccttgttctgaagtcgggctgacagggagtcaatccagatttccctctgggtgacctggagcaagttacttaacaatccatgcgtcggtcttcccatttgtaaactggagggaggaggggagggttggataatagtatctctcttattggtctgtgttgagggttccatgagataatatgggtaaaatgcttagaagaacatttggtatatagtaagcatttgaattacgcaagcatctttaatagttttggtagaaagaccttggtttaggattcagggacctgggtcctgatacattttcctgatataagtcccctccccttgctgaatctcctcttgctaaatttctaaaatctctaatttttctttgtattgaatcctatacccttgtagtactatattagtgtagcaattttccaaaagccattcatcttagagggctaaatgattttaccttatcaattcctcctgtgaaaaaatatctctaaagaggttttctgctggaaaatattgttgctgtcacattgatatgccaacaaaagctaagcagggaggtcaggccaagaaatatctccctgcaagagaaggcatcgcacatgtatctctccatgctatttaaatttgcattctgcaacatagaagggataggccatgctgcagaagccaggtccaggaaactgctttctttggcctttacacatccttttggagagatgctggtgaaagcagcaactaccatctgcctcctgttgacttagtgtcagcaggtggagggaggaaggagggcatcgcagacatcattctattatctcaaccttgctttctcggatccaaaggccaagaagttgctgctccatgccctcagagctctaatttggcacctcttcctgaaatgagagcttgaaagggcttctgctctgggtgaaaccggctcgtggcccgggccaattctgctggcttcgcgtctgtcagtgtgtcctaatcactgttataagtgtggttctgcggaacatcttgtaaaatattttcctattgctccagcaacatctcctgtctagacaatctaattatgaacacagagcaaatagctgaagtgtatgccgcccccaagggttgcataactccaggaatggggctaggaagacaggggagggaggtgtgtgtgatgttcattacttttttgttgacctgaccagaaaattgagtgctccaaaagaatctggctaacttttaattaagaagaaatgatctggtggaagctggcattttgttgtttttccaaagtcagtggaggattaaaggtactgatgtgtttccctctaatcacgtctttttcttggcttcagaggtggtttgtggtctttgcttaaaaaaaaaaaaagaaaaaagccattgacttaataatctgccctcccagcagcattttgcaaacagaaggcagctcttttaactgtatgttctttctaagcagtaatttgattacattcagaaagtccttcctaggcttggccatgtggcagccattgtgtacgacagagtggcaagacatagcctctgccaccaagatgttcacagtctcaatgcgatgcaaacgtatgcacacacatgctttagcccaaagcaggctttggttagggctccagcagaaaaccaacagtgtcatgggcacaggagagggagaaagaattgctactgggagatatgggaaggtcttaggaagaaggtagaatctgaggagtttattacgggatgagccaaacttggacagagaaatagagaaagcaggacaagggcaagcataagctaatgcccaactagtg

SEQ ID NO: 1217 - DNA, 4212 bp, Homo sapiens
ggccagtgggggctggggccccagggcgggggtgccggtgggggcagggggcgcagggcaggtgctggtgggggcagggggcacgagaggtttgggaactctgtaccttctgctcatttttcctatgaacttaaaactgctctaaagacatttgaaaataaataactgtatacatgtgcatagatacatagcagtgccgtcccgccctcagtccatggccctgtagcaccctgagttgtcaccaatgttccctgtgacattgttcttttcccatgacagctaacagtctggcagggtgccataggctttgtgcacagaccacctgccacagaacctcccgggcctgccctgaggtgggaggtggcaggatgagctggcagagaggagctggggggcctgcaattccctgggggccaggccctggccctggagtagggggtccgtcagccccttcactcttaaggaagctgctggttcagggccatcatggccatgtccgccgggatctccaggccagctcttctgcccagggctgggagctcacaagggcccatctcatcacccctaggccccttctgggtttaacccatttatgcttgaggttgcaatttttaaaatgtttacatgagtaaaaaatcagaccttggtgatgacattgagcagttggatataaataactcccacaggcttagcgttccaataatgaaacactaggcataaatgttatcaagcggcaagttctcatggccagtgctgtctccttccactttgactggagagccagtggccgtggagagtccagacacaggcagaatggctctcatggcccccatggctcctggccacgtcattcgaagtgtagatgctgggcctaggctggccctgtgacctctgcctggcctgacagagacagaggtgggctccacgggaatccaggagcctccggtgaagtccagaggcaagctggaggtggggaaggatgcttgctaagcccggtgcctgcctcccggctcttggccctgctgttgagcgggtttttctagtcttctgagataaacacactcaggagtttgtagggtttgagcctccagtatcctcacattctgagactaacagctcatgcttccagggtgccctggcctcaggtgctcagattctgcgattccggagtgcaggctggggtggaggaagtccattctcttgcattctgagattcggcctccagcgtctgctttgctgggatgccctgctgggctgcaggctccccaggggaagggaccaagcctcgctcctctggatccccttcccagggcccacatgattttctgagagcagtgcttatgatcgatttcttgttttatcaaataagggaaagccatgagcttcttcaagctgcatttagcagtaatgaggacatgcccttatttctcgttgagctgtggctgccagttacagacgggggcttagataaacactcgccagcaacctggggctggggccaggccccaacaggagccctgtttgcactggtgctcgggggagcctggcgaggaggtgcatctccatgccggagaaaagcaggtgtcgtttccaaggaaacttcgcctgcacttttctaaacatgagccggcggggctgtttttttatcatccccactgcacaaggaggaagcctcttctccctgggcttacagaggatggagaggcagaaacagaaaagagagccgggccaggcctgttgcctgccacccaagggaatgttcaccccaggagtggccacccccaggcctgtggcaacgactcagcgtgctgcccatgtgtgggtccgaggcccggtggcgggcagcgctgcagacaccgcacaggtgatgtggccgcaccctgtccgggggagcttgaaagctcagaccctgccagagacggtgtcctcaccaaagggcagcacggcccggggctgaacgtgtggctccccactcacccctgaggacccgatctgtgaaatgggaggaactcctcatttctccatgcagcatggggaacagtgagataataagaagggcctcctgcactgatgctcccggattaaaatgggagccacctcatccccactaatcagcaaggagctttcaggagacagcacagcatgagacagagtaggcccgggaggtgggctgtctgtgtcagcgtgggctctgatgcttcctcgctgtgtgtcctcaggcaagtttctgaacctcgctgggcctctgctccttctcagtaaaattgggatgatcataatctctccctgagagggctggtttgaaggccgaatgagttaatgaatgcaaacaacagcctccccccaacacacacacaccccaccagggtaaaatgctcagtagacattagccgtgtcccgtgagatgttcgccatctgtgggagagacagaagcggtgaaattcacaaggaacatacctgtatgtacagcgaacagtgggcatgcagtaaatatgtttagtatggagggacacctgcttactccagaggacacccgccctcctgggaaggtgcctccacagggcttctgggcagagatgctgcttcaggtctagggctggcgggtgggctcctgcatggtctgcagtggagcttgagggagcagggctgccggtggctgctgtcctggggaaggggggcgagactggagccaggccccagcagctgacccctgaggccctacccgcctgcctgggggatggaactccaggtgtggacacaggagtgctcaggattggctagaagcttcagaaacactgccgcccagagccaggcagggacttgtcccaaagatagagggggaggtgagctacgggccacctgcagcctgccccccacctgccttctctcccctgaatcgcgctggaaccgtgattgacaagtgtctgcatctcctgagcgcctctccagagcggagcccggagctctgtgagaagagcttttccctccactgacttctctgcacacccttcccttgaagaatgtagagaagatcgcattttgtaaagtaaaatatttgctttttctaaaagcttcaaaatcatcttttttttttctttctttctgggggaaatttggcagctcaagcagttcgtctgcctctggaggatcactccaaataacaaaatgctgtcaggagcctggagccaccgggcagtgctggccatgagtggcctcttgagggaaactgagacaccggccccatgttcctggtgctcggaggcgctgcctgtggcaggcaggtgtgagctcaggtgcccagaactgcctcaccaaagccgagcggttctgaaagatgcctctcaagtcttgtcactcaatatgcaggtaaaagtcaaccctgacctcggccttgcagccttgagatctggaaacaagcccaatgccataggcgctggcccctggggaaggtgaggcagcatgggcccagagtcccagcggcctgggttcgaagcccagtgctgcacccacatgagttactctcggagcctgtaaggcgagatggcgtgaaggacgatgtcgctaacctgcccacgacagagtaggtccccacaccagggaggccacactcctcattcatcttcacatcccgagatctccactgggcaggcaaccggcccgccgtgtatgaggccctgctggcggggatgggaagcggggacccaaagacctgggcagtcacaggcaaaacgggggctcctgtgcaagagggaggacacggggggttccccgtgggaaaggggcagccccagaagatgtagccttcttggcagcagggaccacacacggcctgactcaagccagtcaagattttgtaacggggtctggggaccaggatgggcccaggcacagcaggacccaacgacatgagaaggggcccgtatctctgtccaagtccaggctggaggctgctgccaggcacgtcttacagtcgctgcgtctgcccagcttagcagtccaggggagaggaaagtgcccagccctgtggccctagaaatgtgtcccggggaagcgtctgatgggctcctctggggcaatccccgtggctggggagtgggctcacctaggtcaggtgcccacccagagacctgggcagactggaccgtgggatcaggcatagtcagatgacagcaaaagcagaggtctgttgccagaaaggagggaagggcataa

SEQ ID NO: 1218 - DNA, 2145 bp, Homo sapiens
ttcaatcttgcttacattataaatcagctttgtgaatgctgtttttttttttttgcatctctgaatcactgcatgttccacattagtgaagcccaccttgataagattgtattctatgtctttaaattaaattttcttttcacttctctttggttttctaatttgactaaggtttaaaatgttattaagttagttaacctcactttgtgcttcataaactctggcctttttgtagcctccaacaccagatggtttcttataattgtccaggtctttaaatgtgctgtacattttcctaaatgttctcccacccccgcccacctggtgaacccccacttacgccacaaaaccctgccctctgctcgtctgtgaagccttccccactcccacctgaggaatgccatttttgaattgagtgattgagggaaatactgcttttcctggggaactagaatgcttcatactttctgataatgaatatgtttgtgtctggctgtgtcagtcttcttccctctggttgaatggaagctcagggctaaaccactttagcgaggtcatgaggtgctgtaggaacaaaggccccaccacaggcagcctgaatgtgactctggggtcactagctgccaggcctcagacaatctgttaagtctcagtttcatcatctgtcaaatgggaataacgtctagttcttacactcaaaatgtgtgttattgaatcaagcaatgcccaattactcttaacaggttgaagtatctcagtatatacactgcctgctttgtttttgatctgcactcttctgctctttttttttttttttaattgccttgctctctacttgacattataattccttggtccaaaatctctattcttatttttatcctcattttgttttctatatttacagtgtaagccacctaaagtcatttgctgaactggccgagatatactgaaataagtgactctatttttaaaatggtgttgaaagtccccaatgttgtttgccagggagtcgtggctcccagttgctcccacatgctccccttctcctccaggtccaggacagtagagcaggcccacagggatcgtgcggcagatgggagggagagcacggctttattagtatattggcaaaactctcatgcctcattgcactgttctgccaaaagcaggtttgaaaaactaggcttaggctcaaggccaaaatggaaacttcttcctccagcttaaatctagttgcagggatccagggacccagatgtagctatagagacaggaaaagtcatggcaagtggccactgaatgtactcacccaaacagatttcaccaagcatcacatcaatggggaagccttacagactccaggtcatgggtccccattcctcaggtttccattaatctgtgactaaggttcaggcatcagtacttggaaagctccccagatggttccatgatgtagccagggttgaaaccttgaagccactgagcccctcaacagacaggtggtacttattggatgggcggaggaagcagaggccaggcctctcagaaccctgtaaatgaagaaatagctggcaagaaaatgcagcaacaaatggatttttaaagcagttgccccactcagtagtaaaacatggctcagcaatggaaagtcaggctctgatcagttgaatgggtctctcttcctttgttttgggagatgtgagtgaatgagaaggagagagatcaattatgttcttagcaatattctggagtgaggaggggcaaaggatctctcctgtgccgaaagtcagtgttgctcacagacagtcctgtgtccttgtcccttctcctgtttctgggggtgtagtgagcatcctgcagccccatttgccctgggagacctcagccctgcaggtttccatggggccggacaggttcgcgcaggactgccacagtataggcacaaccgtggaagcttccagctcagcgtcttgcttcaggaaatgtttcttttgatatccatactcagatcagtgattgagggatgagttgcactccccagctaattgtatcccactctgaaagaaaggagaagagcagaaaaaggaagcaaagtgctccggttcaggacatgtattagtttgttctcacactgctataagg

SEQ ID NO: 1219 - DNA, 3429 bp, Homo sapiens
catcattaatagatattatttactaaatgtctcctatgattcagtgactacagggttttttctcaacattaagtcttatagttatctcttttttacaaatgaggagacagagactcagaatggttttgactcgctcaagagcacatggctaattagagatgacgctaaggctccagcctctcaaaccactgcatattgtgttccagatatagcagaagagagggaaacatatgcttgtgcatgatttaaaatattctaaaactcggtcttaattatttcacctgtgaagttcacatcactactcatttttctagatttttctaaaggaagtgtgaatgattttgttcttccttctcatactttctaaaatgatatcttttgactgcaaaaatgctcctttcaactgcaaactggcacatatttctggtagaggtagccatagaaatgttcccaagcaggtgaaatagcctttccagagtgaggattttgctcaaccaatgaaaatctagaaaatcaaagccacaatgaaaacagcctataattaatattgttcatttttggcaccttggcttattcaaagccacaatgaaatataaattggaaacattttccatcatgagaaggcctgacacgtgagatcatcttcaacagttccgaaaatatcactcagtgtgtcaccggagcatcagtgagaactggaggctcaagttcctttttgttttctcccagaggtcaggtgctctcatcacactctttatatgcctccgttttcagcacttgccagcgtcctgaatctgatggcacctctgccctgtactttacccccgtgagctcctgaaggacagtcaccatgtctgacacttctctaaactgccagcagtgcctggtatgcagccattgctccggaaatgcttcttgaatctatgcttaagtaacctttttttttttttttttttttgagacagagtttcacttttttgcccaggctggagtgcagtggcacaatcttggctcatggcaacctctgcctcctgggttcaagcaattctcttgcctcttcctaagtagctgggatcacaggcatgcactaccatgccaggctaattttgtacttttagtagagatggagttttgccatgttggtcaggctggtcttgaacccctgacctcaggtgatccacctacctctgcctcccaaagtgctgggattacaggcatgagcagacacatgaatgaacaggtaaacagccatttcaaatttaagtttctattaaaaatcaattaaaaataactagtaagtatagtgtaagttgtcagatgctgcttattcagtgctgcctcccttcatggtcataactgccctctgacatggatagtattatgaatcccattttagaaatgagcatctgaaattcagagaggtcatgcctcttgctcaagatcatgcctcttgctcaaattcatgcctctagctcaaggtcacatggatatttagtatctgtgttggagttggtagctacttgctaccttggcagatggcctaaggttcgttagtctcatgaaaactgagatatgagcaggtgatggggtggcccaagatttcaggtgagcaaatctgttgtttctatgcttttgtttatatcctattatctcatcctgctaacaaaacatggtcagggaaagctagaagctggatgggagctcagattttctgcctccaagtctactatcttttctaaaataaggcccacccagttatgatcaaactgaaagaagagagagaataaatgggagactttgatgttcatttaatatcacactaaaaatctgcaactccattaaaaaaatttccatgataccccaatggaatcccttttacatcctttaacctaagccagggttgagcttcaaagacattagggaataggcttaaggtcacatagagagtaagtggcagagcaggagttgaacacaagtttgtgattccaaaattcacactttatttttccatgagagcgtgatttttccaaaaggtattttagaattggccttttattcgtgtgtgcatttgaacgaaaaggaactaccataaccaagccataaataaacagtaaaaataaacccatagtgagtttatttggctcgcattacaggatgaatcaccataaaagataaaggcaaaagcagaaagagaagctgacctgtgtctctgattcttttcctaccagcctcaggtactgaggagtccttgtggaattcccctttggagttgagagtttcacaagttgtacaatcacaaggagggcacctgtctctgtaagcatttctttctttctttcttttattgtttttataagctcttgttacatggttcagttatttcaagtttgctgatggctttgggaccaaaataggctattctgaaagacacagtgagagaagcaactaactgggacgtacggccaacagtgaatctgatgtgccttagggtctgaatgtcaccttcaacattcctgctcttgagctgggttcagagggtgaatgctttgctttttctgagacttgtatatggcccctttattaggattaaaacatacagcaaatagcatcaattaatttaactcgtaggagaaattccttctgtcatgtacaaaatacatgaccttgtgcaggtgattcaacatctatttgcttgaatgcctcacctgtaaatcagaatcaatgacaggaagtcagaggttgctctgggtgttaatgagctcacatgcagcacagcacatggtaccaacttggcacttgatcaatgctgttcttttgcatcctgtattatcttatgagtgaaccccaactgtagatttaataaatcctagaaagcacctcttcctggtgatgttcgtaaagaatacacatatttcaaatgccatcctccattcatctgtttggtcaggtctgctatattgggtggaaatgaattattgagcacctaaagttaataaaaatgaaacttcaaaacttaattgggtcatgacatacaaaacaaagaaaagtaaaaattctgttccattgaaatgccatggaaatgataatgatagtagtgatcacattattgctaataatcataatagttaataacaatagaaagggagtaagcatcactaagaatatcccacatgctagacattattatggtcatttgtatatgctaattttcaaaataatcttaaggagtagttattttaactattagttgaaggcaattgtttttctcatagggtctttgaaataagagagaaataagctaaaagtgaaatctgtgtttattaatcaggtactctctacacccttgcaaattgctgctggcaaagctattgaagatagggaagacaaacatatgtcagggatgggtgtctgtcccagtaaagacatact

SEQ ID NO: 1220 - DNA, 2021 bp, Homo sapiens
tgggattacaggcatgtgccaccacacccagctaaattttttatttttagtagagatggagtttctccatgttggcccgtctggtcttgaattcctgacctcaggtgatctgcccacctcggcctcccaaagtgctgggattacaggcatgagccacctatagacatgtgccagtgcttccatttcttttcaactagtcatgaatgtgtgtactttttaaacaacaaacaagcaaaaccatttgccacgactgacaaccaaaactagtattttatattcttaagtggtcccaattttatatttcagattatctgaatttaacttaattttttaatatggttttttcaaatgcttgactgaatcttttggttcttcagttttctaactaaaaacttagaggagacagacactcaagacttaaaaaattgaagctgaacaacttttctaaaaacttagcaagctgagaaggggggagcagtttagaagtttagtacctattttcaaatctatggactagcttatttcactatgcaattttagtaatggagcttcagttctctgaaacacaacccacttaccagtctgtgatttttaggcattttgaaactatagagcaattcagaattcttgccttgttaaacatttttcatcttttacctgttgtgacttacatttagtctaatttcgtatgctctcatgtaaatatcatgacctaagaagttcttaggaacaaggtattaggaagtaatgttattatttgtcttcatctcagttcaataattgtagattatgattatattaagaaaaaacaaaatttttttccctgcttttatataggaaccagctatcattcctatatatctctatcccccgtaagccataaagacttattcggcttcagaactgccttcctgcattggaagaaggaagactctcacatggttttaaggcttctgataaaagcttccattacgacagaactgatggttggcatacatatttggcttagcataagggggagtgaatgcctgaattttcatctcaaattatatggccttagtaaattatgaacactagcagtctacttttaaaattttgattgtgagagtcacgtgaaaggcacactcattagaaataactactgagagattttatctgaattttaaagtacactgaaacggtaagtaatgcaatttttttaaaacctgcataccaaaggaatgactcagaaatggctagtcacctggttttcttcctattttttactgttttttcctattccatgctaggtataataaacctcagactgataaccttttaaccaccaaacacccccttttatatagcctcatgtgttagatttgatccatcaaagaaactgcatttatttagtaattattttgtgaaaaatgagttgcttatcttctgttcatgtcggatgtgtcacactgagttgatataatttttgctaaaaataagtcatggctcttctaccagtgcaataatgggtgaacagttattttcacaggacattctgactttgacttttgtagtcctgttcaggaagaactgtttttcttctttcagcccaggcacgaaactgttttcatttaaaagatttctcacttgactacagtcaaatcaagttactaccaaaatgactttatgtacttgaatttcttaataatgtcaataagaactttaaataaagctagctccagatattaatttatgaaatatactttaggaataatcaaaatgtaattatgctagtagtagttaagaaaagcagagatttctgtccctgctttttagttggaacctactatcactactgtgtatctctatcccctggtagccataaagagttctactttagagctgcctagggggcagcattaggaaggaaaacggttcatatggggagctgactttaatatatggaaaactacttatcatttgtatttattttttattcattgtttcttccattccattctgagagtgaacatacttgtcca

SEQ ID NO: 1221 - DNA, 3985 bp, Homo sapiens
ggcgtctaatgtgtagaggctggggacgctactaaacatcttgcagtactcagcaagaatgatccaggtcaaaatgttgctagagccaaggttgagagagcctggcttagtgttctggaaagacccttggcatgaggaattccagagatgcagattgtaagtcaggttcatcaatcacaagcaaaccttcttggtcatgttattcccatctctagcttctattttttcatctataaaatggggataaagagcccttctgcaccctttcctaaataaatgtgacatatcatcattgttcctaaccttaacttccaacagctagagctagctccagcccaccctctccaccccaaaaaactaaaaagttcctgataggaatggtgcagaaagtaggccagagtagcatagctggcagagttagtatttgtttcggctctgctagagacactaagtaagtgagtgcttgtaaattataaggcgcagtttataaattaaaatataaaaatggaaatgcagattactttggtgtggttccaagttcctcagcagtttaaaaaaaaacttaatagacaatcagagagacacaatctgtttcaggaaatagcaagagtttttgaaaaatctttgtaaaaatccttgttgagacgtaaacttactcaagctatgtctttatgacatgaataacacacgttcctacagtggctgaaatggcgtaggcttgagtggccttctctaaagtctcaaaccggttctactttatatgactccatgtgttggcagctcaaaatggcattcattcatgtgttcatgtaccctcatgttcagctacttgtcagttaattctgtcagtattaactgagaacctactatgtgctgggcatcaataataaaacaatgaccaagacagacatgatccccactttcattgcagacagatattaaattaaaagaatgcatacatgagtatgcaattgcaaattttgatagagcctatgaaggaagagaataggggagacctaatttaggtgtgtattagtccattttcatgctgctgataaagacatactggagactggttaatttataaagaaaaagaggtttgatggactcatagttccacatggcctcatggggaggcttcaaaatcatggtggaaggtgaaaggcatgtcttacatggtggcagacaagagaaaatgagagccaagcaaaaggggtttctccttacaaaatcatcagatcttgtgagacttattcactaacacgagaacactatgggggaaaccaccacgctgctgattcaataatctcccaccaggtccctcccacaacatgtgggaattatgggagctacaattaaagatgagatttgggtggggacacagccaaaccatatcaagatgatgaaagcctgtctgagaccttagctgagtgctttgagatgaggaagggcaggcaagtgcaggagggctgcgggcagtaagcagaggctaagggaggggcgaagcaggcagaaagcatgggatgtgtgaagtcacctggaccagaacatgctgagtgcatgtaaggctctgaatgcaggccagtgtggccacagcatggagaataagggagaggaagagatgaaatgaggtctgaaaggtagaaagaaactaaatcatgcaggaccttgtagaccaaggcaaaggcaaagagcctgcatgttgttctaaatgccagaggccattgaaagacgtcagtcagagaagcagcctgctatcctttctacttcacagcagttatttctgactgctgagtagagaatgagaactagttccactgaactagtcctggtgagagatgatggcaactgggacttgactggtggcagagaagagtggaggtggactcaagatgtatcttttttttttttttgagacggagtctcgctctttcacccaggctggactgcagtggcgctatctcggctcactgtaagctccacctcccaggttcacgccattctcctgcctcagcctcccaagtagctgggactacaggcacccgccaccatgcctggctaattttttttgtatttttagtagacacggggtttcaccgtgttagccaggatggtctcgatctcctgacctcgtgatctgcccgccttggcctcccaaagtgctgggattacaggtgtgagccaccgcacaggaaggatcagcaagactagctgctggtttaatttaggagggaggtggaaagaaatggtaagaatgcctcccaggttttgcctggagccagtgggtggatggaggtgccatttcttaagatgagaaagcctagaagaggaaagggtttggctggaagagaagtattaagagattggtcttgggaatgttgagttttaaatgtccatgaggcatccatgtgcagatgttgagctgtcagctagaaggccagtcaggatgggaagggggagatgggtggaggtggatgggaaatcttcagaccataggctaatccttgattctctcttgataagccctcaatgtaacattggttgattgaatgaatgaatgatatttcagaaatacagacattagagggacgatatctctcaggtgcagtcagtaagaagcaatagaaatcttacagaagaatgtgactaagaatatcacagtttggggattccattttaagaccaaaaataggctgtaaactctacaccaaactgtgaatcttgtaagaatctcagatacctcatcaggctgcttatcctccctctcttctcctactccccgttttccaagctaactttatctccacaccctacctggtcttctcaccagagatagaagctttggaaagcctccactaatgtctaatacttccaactctgatgcttgctgtaacaactaaagcaaaattattcatccaaacctcaagggtacttggcttgaatggctacaaattagattccttggggtgaaaaagaaaaaagttcttgtccatttttttaaaatcatggagtatgtcaatcccttcttgaccacatcaccccaataggctattcttgtggttggctgctgaccaaatgtagatcctgtttctggcttcccaccatttgttttcttcataaactcagtgggtgtcacaagtctggaactcattcggaacctatccctgattggcctcttagattgcatcatgttcttgaagagctacctttggatatcttactcagattcctaaatcagcccaaaggccctcaggaccctggcattggtttctggtgacctttgttacctcctccccatcaccagtgtaatgtgcctgtgggatttttgttaccctgtaccagcttccccttctcatgacaacagggcatgactttgctttggagagaatcactcctcctcagtgttcagtctgtgtggctcacttgatgaataccttcatctcccagaagtatacacgtcatctagactagagcattccagaatattccattctcccagccacactgagtggtttagagataaacacaccacccaactggaacaaccagggctaacaaaaccccttgacagggctttttctctctctccccaatttcataatgttctttccatcctctttgttaagggggttttgaaattctgctcctctcccctttatgtcatctctttttttcttgatcaatactgtcagagttttgttgattttattagttttctccaggagtcaagttatgcctttgttgcttttctgtattctatcttggttttctgttttattactacatgcttttatcttcatcattgttttcttttacttattctgcaattctgcactgtgcaaaaaagttaatcagaatcttttattatgcttttttcttttacactttatgtttacaagacagaatgcctttatctgtgttcctagttctaggagaatgtgcccagtcttttagttgggttgagtggatgagaagtacatctgtg

SEQ ID NO: 1222 - DNA, 1907 bp, Homo sapiens
aatagcaccactgtcatttgaacaatggctagttacttgcattttttggcattgttaatctctgaatctgggttttcctctgaattccacacagagcatgcactacacaacaattttatcagaaaatgctttctttctacacacattttaagacaagctaccaccagaaacaaatcaatataaatacatcaggggctgaacaatctcaatagtgggtgagacacattttgcagaatcctgccaaacaaaggaactgaaaagactgtgggcaaagcaaatgagggaaagttaaagaatgaaatattttaaatattaataattaattcagacatgatactgtattttctgcaaaagaaaattaacatttagcaacacactaatgaactttatctccaaagagattagtgcactggcaaagtatgcagattacagtggagagctgtggacagcacataccgaaaacaccccagtcttgcagatcccaaggtaacaatggccttcattgaccactccctttgccagaggtccagaaaacttgcagcatggtcacctgcatgcttcacttccatctctaagcagcaaacttcaaggagccaaagaggagtccccagtgggaaaggggagcagagaagagaaagatggtaaatgcaaacctaaaagacagtaaaatgggatacaatccccattcaaatcccagagatgtgggcaagttcccaaaagtagtttttagaccaaaaaaactggacacacctcacttccccaaaaatataatacatagaaattttggggataactggaaaaatagagaaatgctcagtgaaaaccaagctcttcacctcgaacatctcagggctgaaacacatcctctattatccagtcaacaatgcctcttgctttttagcagggatgcaattggtcaatggcaccaaatggctttacagggcaactttttaaatgttccttttagaccaaagcctaggcctatgaggattcaagcagccctctaagacttgtgacagcaagttccaaaggttccaaggtctggtccttccttcccagatacaacatcaaacgcaaaatcctctgtcatgttacattttgtattttgaaatatggaagcatattttaaatactcataaggcatttatttattacaacattctccgatttcacattagcttaaaattcaattcagtctttccatttctccactaaggtcgccgcctcagcatattacacaacaccttctccagcactcagtgtgacccgcatccacagggtaagccccaacgtcagcctctttgtttcccaggtgaaccaactagatgttaatactgctctgctacaatgtaaacgctcctaattcaaacttatttgaaaaggagtgaaacgtctgcaaagtgcactttaagaagaggtactttttgcttatgaaaagaaaccagtgagtcctctaaggataataaaagggagtattttacagttaagcacatgatttggagtgaagaatttggatgttgctctgctggtccaggctgttaatactctttttgttcctcctgtgtgccgccttcatcaggtatcacaaagccttcatctgtggcatacagaatgtctacagtcctctgcaatacagggttgttttccccctcattctcctggcaaatcaattcaatgttccgtagctttccgaagtagaaatccttctttctccaagttttcaacagtaaatttcaatacgttgacctgccgcatcaactcagctgcctcgtcattcccattgcccacaccagggttctttcacaccacgccagggccagtcttaggagccacagcagttctctgtgttgagatgggcatctggggagttgcattgctagaacttgggtttattcggagctggagca

SEQ ID NO: 1223 - DNA, 1503 bp, Homo sapiens
ctgtgttcttgggttttattgctagaaatgcactgagcacttttatagttttactgtgcattctcttcaaggcaaaattgttatgtctatactgatatgcactgtgtataggacataccattaaaaatcaacttgtcactgaggagcctgaatctgggaatagaattactgatgtttcaggattctagtgaggatcatggaataaaatttggtgatttcaaatttgggttatgaatgccttttagccatgtgaggttaaaatggttgaaatttggtagtataaaaagtcaccggtttattaaaaatgggtttttaccaggactctccttggttccctttggtcaattccattagaaaatcattagctgtttacataaataattgcaaactgctagcaggtaatgtggagatcttaatcttttttttttaagtggaacttaaaaaaatgtatgtttagataaatttttctcttcttttctcccatccacaatccctgcccatttccctactttagacagacagcaagaagaaacgaaaccagaggagaagaatggagctggatcgtctgtgaagaccctgccaggctgcaaagaagctgcactcataatgcagagaatgcagctggaggagctctttgatttaactgttgttactgaaatctgtgcagcatcaagtgacttagagcaggaagttatcttagaattctggaaagattcaaggtgattagacagttgacgagtgagagttcaaagccggtaccactcatttcaggcaaggtttgggcagtgacataaatccttagccaagagctataatagtctcctttaggctccttgaagataggaggcagatcttaatcctttctgcatctacagtgaattgtatagaacaacagtaggtgcttcatgaatagctgtcagatggtggctttgtatatcaccaaaggatgggcctctctgtccccttgcagctctggtgctcatggattaaattgtttggtccctttcagttctttctatacctggcttattggatactctcaactacatagttggaaccctccttttcccatgcagtagtgtctcccataaagaatttttgtctagattctgtaacttgtcatccatttttgattacaagaatggttcctattctattatttaagactcatgcctcttcatttttaaaattcagttttgtgtgtgattcagatcttgagccctcccctctctccagcacaggctagtgctgtgttctaaatgtttgtgtcctcctgaaactcgtatgttgaaacctaatctccaatgcaacagtattaaggagtagggtctttaggaggagttcatttgcccctttccccatgtgaggacacagctacaggcaccatttatgaagcagagagtgagccctcactggacaccaaatttgctgacctcttgatcttggacttcccagcctccagaactatgagcaataaattgctgttgtttataaattacccat

SEQ ID NO: 1224 - DNA, 1829 bp, Homo sapiens
ttccctctgccgtctataaaaatattagtacagtaaatttttcagtagcatccatgtcagcattccactacatagcatgggcagagagtcaggacaagtattgttaagtagaataggatcctgttcctgatatgtgttaaatccatgctgaaaaaaatctatgtatagtcactgtattcacacacaggtattgcaagtattaatgtaaaaatctatatataattacatgtcgatgctatgattactctcttcaacatatatttaagcttattctaagaaattagccttttattttaatattaagattaaatattattaatttaatgaattattaatttttatcatgaattaatttgagtaatctcatattttcaaatatgatctttaattcatttatttgaacaaaggtttatttatgtcaaaactttttatttatgcagctactttcaactttcaaactaattgcacattttttcatttgatgtttacaacataccagtagaagggaaaggtagtattagtcttactaagactaatagaagaagagaaggagattgaaattagtatgaacaaatgtgtgtattggttctaaggtaggaaacagttatttttgcaacaaaattaatttgccaaatatttatgttcaagtagttcatcaaataatttttatgtataaacatttatgattaattactatagtactgagtgtgagtcagacaggtgaattttggatctttccagaggcatttttctaaatggatatgcagtattattgttgttgtaatcagcaatattttttttttcctgtagcatcagtctttttccttcagtttctttgtggtcttaagataacacagcatccatcttgagtaaggatgcagtcattgcaaattccatggagaagatgtcaactgtggacaaataaacactactgctgtgttttatctggcttctcttagagataagcactctgaggtcaagataagtttttatggtcctgtgctgtttattaattgctttaaattatgataagaggtcaaaacacaagggtccttctaatttatttcataattattatatgtgtatatgtctgtgtgtatgtgtgcatgtgtattatgtctcagaggaaaaaggtgaaaaatatgtataatgtataatgaatttagagacaagaaatgtgagaggagacatgatgttctgacagccagagaagtattgaagtatggtgttagccctattggaggctgtctgtcagcttgaagaggaaaaatccttgaaactattttgttcacagccttgaacaaatctgcaatgtaagattaatttttatttgcataaagatcccattactcatataattactgattattttgtcctctaaagttctacatgtctttttaaggagcaaattggcttggttgtcttcaaatatttaactaacagaatacagtttgttcaccctaatatattttcatgccatttttgtgctactgtcaacattattaaattcataattttgttttcatgcttgggctacattatatccccaattctcaaaaatgaactcacaactaaaatggggttcattgaagcataaaaagtgatgaatttaagagtaacatagatagtgcaacccaaaataacatcataaacaaagagtgaactggtctccagtggtaaatatgagatgcaaatctgtatatgcagggaaaaataaacctgcaagtgtcatgatttcacagatgtggcaagaaaagaaaagtgcaaataggtagtatgtttatgaatatccaaaaaatttgaattatatttgactgaaaattcattta

SEQ ID NO: 1225 - DNA, 1260 bp, Homo sapiens
ccagcctggaagacagagtgagactccgtccaaaaaaaaagaataaacaaattacatttacaatcagctggatgtttacatttgtacacttattgataacacattacttcatagacatttgcactaatctataataaacaatttaatattccctacataattgaaaaactatctctaacagacaatgatttatatttgagaagttaagatttttcagattttcaaaaactagtattagatatgtatatataggcatacacatacatttaggcatttttaaaaatatggactttttttgaagaaagacattaaatgaggaccttgggatatttaataatggatataaagctttattcaacttagaatcagtaaccataaggaatatataactacaaaacctgtatattgacattaaacaattaaatttgatttatgcagcatggttttaaaaaagtatcactaaatgaaaaatgagtaaggactggtgtactttttttctctttaaaccatcttaactcattttcttcttcagctaaaataacttcaggctgacagaattaaacattcagccagagaaatactgagtctcattaattattatatatatatgccatattttcctaagtatctatgtgcacagaatttccattcaatttaatgaagttatacttacataaaaatacatacatgtccagaaaaattagcttagaatttttacatgtaaaatctactgtttttctctttttccttatatttctttctaaaacactcattcataacagtatatcttcaatattttgttttaattgataataatattataaagtttctccttttttcatccctatgctcaatttgaatgacccagaacagagttttaaacactagtttaatcatcaatagtatcacaaccatctctggtgtgtgttaaagagcaaattctttggaatctacaccaaactacaccagatctacagaatatttggactcaggtatatatatatatatatatattaaatatatgatagtaataactgtttaaaatttatcaagaatgaagtatgtgcctagaactttcctaaacattgtaaatattttaacacaagttatcaccaaaacaatccaaagaagaagctattattatatctgggaaaactaggcaagttaataagttttggagctatgatctgccagcttcacttcagaatcctggctcttgacttcttgcgatgcacactgtttctatttgatgagtctaac

SEQ ID NO: 1226 - DNA, 2443 bp, Homo sapiens
ccaatttttttccaggagcctgacaagttttatctaaaatgttttgtagcctttattaaagagaaatacaatgttgaagaaaaaaagataggacttgacctgcaaagtatcaaaaattatcgtaaacgtatagtaattaggacagagtggtattgacaaaggtatggacaaaccaatcaatgggaactcagaaataaacccaaacgtatacagacttgattttatttcagtacagccatgttagtttcaggtgaaaaggatagatgtttttcagtgtgtggtactgggacaattattaggttggtgcaaaagtaattgtggtttttgccattgcttttaattatttttaatggcaaaaactgcaattacttttgcaccaacctaatagttaactttggggaaaacatggtattagactcataacagtctttagccagactgtttaaagacctgtacgagaaaagtaaaagcatatgactcttagaatcttatatagaagagtaactttattaacccctaaacattcctatgcgtatttcctaaacacaaggacattctcttacataaccacaatttaattatcaaaatcaagaaattaacattgattcactactatatcttaatataaagaccttattcaatgttgccaatggccccactaatgtcctgagagcatcctgcaagaacagaattctactgtaacccccactgtgttcagtcactggctgtaagcaaccctgagtgaaggccgtggtggatcacaacagctggaactcaggtcatttctgctccccacagcaacagatctgggtgacaagtttctatagctgctaatatagtttggatattggctccacccaaatctcatgttgaaatataatccccaatgtagtaggtggggcctagtgggaggtgattggatcatgggggtggatttctcatgaatgtcttaggaccattcccttggtgctgtcctcgagatagtgagtgacttctcgtaagatctggctgtttaaacatgtgacacctcgctggttatctctcttgctcctgctcccaccgtgttagacatctgctcctcctttgccttctgccatgattggaagcttcctgaggcctctgcagaagcagttgctggcgttatgttttctgtacagcctgcagaaccatgagccaattaaacgtcttttctttctacattaaccagtctcaggtatttctttaaagcagtgcaagaatggcctaatatagctgctacggtaggccttcttgttaccaaactagaaaggtcaagagaatcctagaagtccatcctgagctgagttgttctgctgtgcccacctcggcaactgccggcctctgacctcttggtaggccagaattagaaacctctctatgtctgagccagtgtaagtcaggttttctgttatttgtggtcaaaagcgtttctaactgacataagcccctaaaaatagaaatgccagatttttttttttttttttttttttaagagacggagtctcgctctttcgccaaggctggagtgcagtggcatgatctcggctgactgcaagctccacctcccaggttcacgtcattctcctgcctcagcctccccagtagctgggactacatgtgcccgccaccacacccggctaattttttttttttgtatttttagtaaagacggggtttcaccgtgttagccaggatggtcttcatctcctgaccttgtgatccacccacctcggcctcccaaagtcctgggattacaggcgtgagccaccgcgccctgccagaaatgccagatttttatagctacgcatgtacacacacacaaacacacatacacatactcaaactgctctcaagaaaaaatttaacaaatgaattacataatatatgagtacagctgtttcctctcatgacatgcaatatatttttatcacttcagcttattttgatgattttaataggcataacacctttctttaacaactaatcacacagaatcacagaattttagagttggaaggaacttgagtgattatctcatctaaactctcttacagtacatataatgttaagaactgtgtttacaaataagtgaagtagtcatgaaagaaaaaagtgatgtaacagcaggtgcaaaagcagttgaacccaggtaagagggttgtccaattacctcaagccaaataatcaacgtgtgtattcatgaatgtgcccactaaacattttctacaatgttctttatggtcagaatcagcaaactctctttttcacagggaatacaatagcaaaactttaaagaaatttacattgacgaagctgtaccacgttgtcatgtcagtataatgtggggggagaagcaaattatttgatttcagcttcaatcagttttattgtaggctccgccacttgctaagagtgtaaccctggg

SEQ ID NO: 1227 - DNA, 2370 bp, Homo sapiens
tattgggcaagtcatttaaattgattctatgctgacagttatgtacctactgctaccgtttgaatgttgtcccctccaaagctcatgttgaaattaaattgccattgtaacagtattaagaggtaggatcttagagaggtgattaggccatgagggcttagttgtcacagcgggggattaaggccatttaaaaagggtgagtttgtgcctctttgcttttctgctcttccaccacatgaggacacagagttcctctctctttaccttttggccatttgttaacacagcaagaaggcttttgccagatgccagcaccttgataatgaatttcctagcctccagactgtgagccagtaagtttctgttcattataaattaccccatctgtggtattctagtatagcagcacaaaatggactaagagacatatcttgaaatgttatccagttaattcaagagggatctgggtgacaacttgaatggaatagcatatttcacccataaaggttgtgtctttgtgtgttaaggctactataacaaaataccatacatagactagatagcttataaacagaaatttatttctcatagttctggagggtgagaagttcaagatcaaggcaccagcagatttggtgttgggtaaggaccttttgctggttcacagatgatgacttctcactgtgtcctcacatggtggaaggggctagctacctctatagggtctcttttatgtgggcactaattctagtcacaagggctcaactctcatgatgtaatcacctacaaaagtcccacacctccaaataccatcaccctgggggttaggatttcaacatatgaatttagtggggacacaaatattcaaccacagcaggttacaaaagtactcaaagtacatgtccatcttgtagttggttagtaggtggttttcctatataaagcatggggcacattgatgaagtgactgatagtgaaggtgattggaccatgatggataatataaatcacgacactaagttttctttttgagaaatggacaataaaatgtcttctctggctatcattctattgatgatgagacaaattttgatactttgcttttttttttttttttgctatggaacttggtgaaatattgactcacttttattggcttgtgcatgtgtactaaagatgaaaatgatgaacaacaatttgagtttgtatagaacttcctttctggaaactttatttttggcaggtatgtgggaggggtgggggaaatatatgacaccaaacaaaattttggcaaaggaacaacaaccctaatcataaatttttaggcatttaggtgatttttgatatgaatatttaaaaacatgttaacctaagctaatgtttagatgtgtacacattgctttttacttaactagaagattttaacatttttctttgtttgtatttcacatatatcagtaatgacttaaaatgacttacaaaattaataagaaagattttttaaaaattactggtaagggggctagagagaagccactcagatatcgtgtgtgtgtttggctggtgccatcttttgttagggaaacttggcaaactacaaaatcttaagagtctgcattctatctgacttagcaattccacttttaggaatttactttactgatataatcaagggtgaggccaaatatttagatatattcactgtgtttagctatgttgcacaattgtttatagcagtaaagaattgaaagcaatttaaacattcaacagggggaagttggttaaatgacagcatatccgttttgcgtatgccatgcaattgtttaaaatgatgttgcagaatagtatatgattctattaaagatgttcaatatatgctgttaaattcagagatgaatgataaatattatgtgtagaataagccactttttttttttttctttcttttttttttttttgagacggagtttcgctcttgttgcccaggctggagtgtaatggcgtgatctcagctcaccgcaacctccaccttctgggttcaagtgattctcctgcctcagcctcctgagtagctgggattacaggcatgtgccaccatgcccggctaattttgtatttttagtagagatggggtttctgccatgttggccaggctggtctcgaactcccaacctcaggtgatccacccgcctccgcctcccaaagtgctgggattataggcatgagccaccacgcctggccgaataagccactttttaaaatgtatatgtatgcattggaaaatgccaaactatcaagaactaaatgtggtcagtgaaaaggacagatcatttcactttcttcttttctcttatatgtatttaacacatt

SEQ ID NO: 1228 - DNA, 4158 bp, Homo sapiens
atgtaacaagaagcaattattggtaggacctttgtcaacataaaattgctagttgcaaacctaagtgcaaaatgattttcaaaggctatagctccagatgacaaccctaagaggtcttctgattaagtccagtcaaacctaactttggttttgtttcttttttaattgttaagcgaatttttgtcacattaaaacagcagagctaaacattgaggctgttatttcaaaagaaaaataacttttctttgtgaggcaatttataccaaaacttttctgtttttgcccaagtataatttgcaatgccatcaggcttgctggcagcagagggatattgtaagccatcacaggaatttaggaagttacatttataataatgtcttgcatttgactagtcatttgaagttcagcaaaacccttcacaaacctgtatcatttcatcttcactaagaccctgtcaattaggtagggcagagtttattaatccccatttaacatattatataaaggctcaaaaaacttaacatatccccaaatcataccactgctcactggtacgtcagacctagaatttgagtcttcttacttctcccattcttttttttttttttttcaaagaaaaatccaggagtgcagtggcaaatcatggctcactgcagcctccactttctgggctcaagtgattctcccaccttagcctcacaagtagttgggattatgggcgtacaccaccatgcccagctaatttttttgtattttatgtttttccttagagactgggtttcgccatgttgcccaggctggtttcaaactcctggtctcaagtgatcctcccaccttggcctcccaaagtgctgggattacaggcgtgagccaccgtactggccttttcctgtccttcttaacactatgctttgttgccactttatttgaatgtagatgttaaatattttaaatattctatatattaaatattttatacttaccctctaaaaatgtgatcacctcttctctaaaatcttattggtaactcctagacaactggactataagaatattaattatgttaccttgatgataatcaaactttgaacatactatttatcctaataatattaacttatctttctttactctgatgtttaaacttttcacataggctaatttcagtgactctgtaaattttagttgtttcaaggagatcaattatattacctaccatacttagcccattgtaggtgcttaagaaattctttttgaattgatcagcttctatctaagaacattatagatcatgttagcaatgaaatacaaataagacatgtggaaaattattttacattatcttccctagaaatggctgacaaattcattctgatgaaagacagatatggtgcagtgaatagatgctttcacagatgcattagaggtcatgaaagtaacccagacacagtctaaatcagtctctggtgtgctgacagcctgttagcatagcgtatgaatacccctttcatgatttaaaaacattttgacgtctaaaataacactgtctagctatctgtgatgtatgaaattatatcataaatgagtagttcaattcaatactgagatatttagaaaagcaaattcaataagctaataagtctatgtgcttttcctgtctatagaaactaagtaaaataacatgtttttataacatcttttttgaaaaaaaaaaaaaccaatcaatttcaaaatgctttacaaattataggcttactactacatttcacatcccattatggcattggtaagaattatcaattcatttaaaaatgtaaataaatgaaaaaagaaaaacaaataattctagaaacaaaaaaaggcaaaattatttcaaagagcaataaattgaaaggtaggctgtctctgatgacagctaatgtatatttatgatgcacttcattaaaccctgtgactttttcaagaggccacctgtaagccagttatgacttacaggttttaggaatgcattatattcttggccattactctccaaatcaagtgtttgagatgttctcaaagtccaggtgagacctaaaccagcactgtccattgcaaatataatgcaaatcgcatatgtaatttaaaattttcaagtcatcactttaaaaaagtaaaaagtaacaagggaattttaatgatatattttatttaacccaaaatgtccaaaatattgttattgcaaaatatattcaacattaaattttattgaggatatattttacatttttttccttgtaccaagtttataaaatcctgtgtgtgtgtgtatgtgtgtgtgtgtgtctgtgtgtctgtgttttgagacaaagtcttgctctgccacccaggctggagtgcagtggcacaattacagctcactgcatcctcgacatccactatatctagctaaattttgaatttgtttgtagagatggagtctcactatgttgatcaaactggtccttaactcctggcctcaagggatcctcccacctcggcctcccaaagtgctgggattacaggcatgagccactgcgaccagcccagtgtgtatttttatgtatactttctgcaatctcaatttggtgctaaatttttaccagaaatacttgactttaattcggttttcataaaatttatagttcaaaaagtaaggccaggtgtggtggctcacacctgtaatgccagccctttgggaggctgaggtgggcagatcacttgaggtcaggagtttgagaccagcctgggaaacataatgaaaccccaactctacaaaaaaatataaaaattagctgggtgtggtggtgcatgcctgtagtcccagctacttgggaggctgaggtgggaggatggcttgagcccaggaggcagagattgcagtgagccgagattgcttgcgccactgcactccaagctgaacgacaaagtgagatcgcatctccaaaaaaaggagattaacctatccaaatattccaagtgtactaaaaagtttcttaataactgcatccagtagcagttttcaatttaaattaacaaaaacttaataaaattaaaaatttctcagtcacattagcaataccattgataccgttatcaatggtccaatgtaactggggccgctatattggatagcacagatagaaataaaattaagcaacaaagaaagtttcgactacagcggtaggtaaaatatgaataaataggaaggacggcattgcagaggaagaaaacgagttgaaatgacaagtatggataaaactgctttttgtagcccccccttttttttttcaaaactgtttccaaaattattctatcatattgtgttcccagaataactttaccatctgtttattcactgtccacaagaatacacaggatatagttttagaggtagaaaaaaactaatgagcatacatttcaaattcttttaaagaatgagaaaggcttggtctagagctgcgctctccaacacattagccagtagccatatgtggctattgagccttgaaagatggcttatccaaactgagatgtggcttaaatgtaaatatgattaaatttcaaagactcaggccataaaagaaggtaatatatctcattaataatattttattatggaatacatgttaaatgatattttagatatattgggctatataattatattactaagattaatttcatttgtttttttaatgcagctactagaaaattttaaatttcatatgtggtcatattatatttatattatatagcatcatctagagagaaagtttacttttgcttatgtcacagcattgcctgtacatgcgatttctgatattcaccaatatgctagcaggaaaaatgctagcaggaaaaggctgcatattcctggccacagttgggccttaggacctggtttcctgtcactggcttttgcaagcaaaattgggtacactcatgaaaagtagagcctacatgaaaagaaaggtttatttgtactcattttcagctaattgttgttttgttttgttaaccttcttttgctcacttatatttggcagcttgatttgtgtttttcattcttctgaagttgcaaaagcagcaaactgcaccacccattgtgggtgactccatgtaattaccgcgtacagg

SEQ ID NO: 1229 - DNA, 4232 bp, Homo sapiens
ctcaatttaaaggggtgcttattactcagatctaactgaataatatcatgaggggatatgaagtccaatttgtcaaaaaaaaaaccctgaaaatacaactttatttcttttattgttgttattgttgttttgcaaaatttccttattttaaaatatttgtaaatatttatatggtcataaaacacacctggtatgttacatgtttagtgtggccaaacaacacagacattcaagttagaggttaagggttgctagcttgtaaattctggaagatagactgctaaattcttcttgtaagttatcctaattcattaagtaacggtaagctaatgaaccagttgacaaatttcagtctgttgttttttgatactagaagtgtgactacccttctagcctagattcataatatcatagcttctgcatttttttcatgctcacaaatgctagtaatttaatcctctatatattcttaaactcttcttacagttaacagttctctgggaaccagaaatatttgtgtttggattatctaatgcatcttgatcccacttgaaactttgaagggaataccatagttgtttctctaataaaactatttttaaatgtggctaaatttcttgagtaccctataggatagaggcccaggatcattcaatgttaatgaaaacatgagggactttaatagtagaagtgaaagcaattgatatgattttataatgattaggagatgaagggcgcctctttgcgaggagattgtcaaacaaagctggaatttaagcctgtatgcctagtgagatttcagcactttgactaatatttgtattaaccaaatctgtccttggccaaatttatcttaaactagtacaagcaaaaaataataataataatttagattaaatttataccaatattttccctgaaagccctagactctaacactttcctagaaaggtaaacatctctgcttaccttgtgggtatgggacagtgaaaagagcacactgcacattgagtggatggagggaagaaggattggcaagagctttaatggcaagaaggaagaactccactgggtactggccttgtaagagtggctagagggcctgtgcagaatactcttcccaaatccttagaccaattaatgagtttccccatctcctcttcccagcttcccagctgtcttagacagtttctgtctttctcccagcatctgtcatttcctcaatctcttttaacctcatttttattctcaatcttttttccggatgttggtttctgtccccaccctctctccaagtcttttttctagccccacgcctaacaaatatctcccatttgcataaaaatgagaccacatggaaaaatgaaaaacatgtttttttgttgatgtgtactatgagaaataactctcatgacagagaattggccttttacatgcaaagtggacactttctaacatccctaactgaaaaatctctaaaggaagtaaacattagggaatagaataaaacatcttgctgcagaagaagcgtatctagtgataacaggatgaaaatgaagcaagataacttcaggcaaaatgtataagaattgtttgttacacaaaggttatggaactgtagatctggaagaaatctttcatatcacttgattaaaccacactcattttatagacatgaaaattaaagccttgagaggttaaaaattttgcctgcctcagtcacacagcaagcatgtggcccctggtaactaacccaagtgctcttggctcaaaggttcagtgtactcttcaccacttcagtatgctggcttgtcacaccagtcagggctcaatgggaaaaatataagaaagttgttatattgccaaatatattcttttttttagtgaaagtaccctttcttttatgtaatattctaatgaatagcatatgtattatggggaaaggattctgtatttaacaaagaacaaggtggtttatctcatgtcaattgcacaaagggcgtttggattatttactgatctaggaacaactgaattatgtggtgcttttgcttctgcacaagattaggataaagttaattactcaacatactgaattaagacttcagagttggaaaggcaaactatgtaatcaaagtgcctttacaattgaattttcataattttacagtctatcctagtgggggtggggactaatctgatctaaatggttcagaattacctgatgaattacagaccactaatttttgtatatgtgagcaagtaataggaatgacttggcacttgtgttcagatattcatgacactctggtatgatttgaacagtcactataattcaaagttaagtattttctgctatttatacaatagtaagagggtaggtcaacttcataaagcaaatcaaataagtttagccaaccaaacgagtattccaaaatacacttactgcttccgctctacagaggccagggataaaaataaatattgccctcaagtaactgaaaacaaatctaggaatgccttgggtattttcaactcttctgacttttgaagaaacagaattctccaaattaaagcaagggctagctacgaaatatcacctatgtgcccaaaaataggtcttgggaaacacacacaaaaatagtcacttagaaattgtccttgcttcctatatacagttaagttgtaacaaaacctaataatagatgtctaaatgattttttcttctcctttgtataccttaagaattttaaactttaattgatataaaacttgtacccaacaaatgaggctgtcaaaaaatgaaaaggaaagagaaaaaataaaaagttcactgatcacatcatttaattattctaatcccaataatgcaattagttaataaatctttaagttagttcactctgtgcatttaaaaaaggtgagtcccacttttaaaaactgggtttgcagagagagataattggagaattctcatggttgtttagagttgtcacaatggctttgagctcattaatgtaggagtggcctttgtatcctggggagagtgcccaagaactcaacgcttatgttctcacacttgctgaacaccctaggagggcgatttcacagttcataccacaaaaaagtatttcttttcccacttcagttaaaaataaattcaatgtgtgatacaaatggttttccgtgttttgtgtgtgtgatttttataactgaagcattatttcaacacatggccatttggatgtgaacagccataaaaattatgtaaaggtattatggctaaaatagaaatgatacaatggcagttaaaggcccaactagtaagggaaaattctgaaatttatggaacggtttcctatttctctcttgattctgtgagttaatgttaacttatacaataatagctaatgttttagtaatttatgatgtgcacagtatctaaaatgggtattcccattgtcatgtaacaccaataccatgtcaatatgtatctttcttctcattttttacatgcagaaactgggattaagaaagatttaatgtctgggccaatttgaacatacttagaagctagactcaaacttaagttttcacattaataccgtgtttccttccactaacatattcaacctctcagattaagcaacactcaatactttatgagagtagtaacaatatttgaggatgttgactattttcagactaaaaagagttttaattaaatacaaacacaattttgcttattaatttgagtgattagtttatagatgaaggtaaataacataaatctgaaagatatttgagaaaatacacctgtttgcatataatgtataaaattgtgcctgcatatattgtaattaaaatattacttggcagtcatcttacaacagttctattgtgaaaaattttcagatgctcatttttcactttgcgagaattaacattgtaattgtttaaatattttctgcttctggattggaatcaacttagaaataaaatatttcatctacggtgcaggatatgagttccattaactcagcaaaactttatataacatttatctcatatcagacgctattctgggtgctttctgcatattaccttgtgtgattcttccaatatccctatgaggtaattccttgtagagatattgcaagaaccacataaggcaatcatctccattttacagctgaggaagccaaaagttgagtaacttgtccaagtttata

SEQ ID NO: 1230 - DNA, 2986 bp, Homo sapiens
gctcccaggtgcctctctagaaagggtacaaaaataccccctggagaaagttaggaatatggtgccgtttagctgtagttttctcacattattccttatgtaattggtgaaatgcaaaatggtctggctcctgttttggacatgtaatttcttgttctttttttttttttttcttgagacagagtttcgctcttgttgcccaggctggagtgcagtggcatgatctcggcccactacagcctctgcctcccaggttcaagtgattctcctgcctcagcctcctgaatagctgggattacaggcacctgccaccatgccaggctaattctgtatttttagtagagatgatgttttaccatgttggccaggctggtttcaaactcctgacctcaagtgatccaccagcctcggcctcccaaagtgctgggattacaggcttgagtcaccgcacactgcctaatctctggttcttaatttgaacatgtcacagggaaaaaattactgtgtataatccccactgtcttcaagaagggtggatcttggtaactagataatcttttgtttgcaaatcacaaattcctcaatctcagtataaagtattaagtatgcaagtttagaaagagaaactgggaaaagttaaatagctttacataaaaagggagagatgggagatgtaccaagaagatgaaggaaaaaagacagtatgctggaagggaaagagagaggagactccacccctgaggatatgggagctgggggaaggaacacagtgtctttaaacttatttctgccttgggctcttttggagtccagtaaagccaatggactccttttcaaaatttttaaacacataagagatataggatttttgttatagtaaagttgtaatcaaaaaaaaatgttaaaccacatttgtttggggggaagaagtgatgaacaggtagagcactggaaacttttagggcagtgaaactatttgatatgatactataatggtgtaaccacccagtgggttcaccttgcccactgcgtagacagctgatttatcaagacaggggaattgcaatagagtaattcgcacagagctggctgtgcaggagacaggagttttattattattcacatcagtttcccagagcatttggggatcagagtttttaaggataatttggtgggtggggggccagtgagttaggagtgctgattggttatgtcggagatgaaatcatggggaggtgaggccatcccctcgcactgagtcagttcctgggtggggaccacaagaccagatgagctagttcattgatctgggtggtgccagctgatccatcaagtgcagggtctccacaatatctcaagtactgatcttgggttttacaatactgatattatccccaggagagatttggggagggtcggaatcttgtagcctccagctgcctgactccttcactgtaatttctaatcctgtggctaatttgttagtcttaacgaaggcagtcaagtccccaggcaggaaggaggtttgttttgaaaaagggctgttatcatctttgtttcaaaattaaactgtaaactaagttcctcccaaaagttagtttggcctatgcccaggaatgaacagggacaacatggaggttagaaacaacatggagttagttaggtcaggtctctttcactgtagtaattttctcagttataattttgcaacagcggtttcagtggtggatagatgacattatacatgtcaaaatgcataaaatgtacatcaccaaaagtgaaccctagtgtacactatggactttgggtgacaatggtttgtcaatgttggttcatcaattgtaacaaatggtaccattctggagcaggatatccatagtggaggaggctccgcatgcatgttgggggaagggacatgggaactctgtatcttccactccattttggtgtgaatctaacaccactttaaaaaatagtctatatgttttaaaaatcctacttttgtgctaaactaatatatacttttctttattaacacttaagaagatctagcactgagtctaccataattcaaattagtgatgactataaacaatattccaggatatccaaaactactgcaatgtgacatgaaaatgactctgatttctctcgctgaaaaaaaatcacaagtactgctaatattattgtggttggtttattacattcataattaaaggaaacactaaatttcaattacaggtaattgaaaataaagatggaaattattttccacccaagctcagtgactacctcctcaaatttcatccaaggcaccctttggggaggagggtatcctatggatccctgattacagatgctttgtctagacctagaatacaattgttccaatttccccatctcaaagactctattgctgtgttccattattgtcttctaaggtttctaacaactcatctgtttttctctttgttgttttggcaagtaatgccagtgatttctagagccaggtgaccctgcatattcctagtgtcctctgatatttaggaaaagcagagctgcctgtgacatgaactgagacaatgtcctgaaacattgtagtaactgagaaggagggaataccacttacagtatcttcagactttttttttttttttttttttttttgagacagagtcttgctctgttacctaggctggagtgtgatctcggctcactgtaacctcctgggttcaagccattctcctgcctcagcctcccaagtagctgagactacaggcatgcaccagaatgcctggctaatttttgtatttttagtagacacggagtttcaccatgttggccaagctggtcttgaattcctgacctcaagtgatcctcccgcctcggcctccccaactgctgggattacaggcatgagccaccgtgcccagcctgggatcttcaaactttctagttggccttttatgttggatgctagaaagat

SEQ ID NO: 1231 - DNA, 2051 bp, Homo sapiens
atcagaacttaatccatctacatagtctcagttctacttccaattcaagacaagtaaccatgaagttgagaaattacagtactttcttgactgcctggaagccaaaaataaaagaaaagtagcaagaattagtttttaacatcccttttacaacatcaaaaaaggttacttagggatacacacacacacacacacacacacacacacacacaaaacatttagattttatagatgaggcctaattttgcatacatggtcaagtagttttataaagtcctgattcatgtactactaatatcaccaatttaggaattaataaaactagtaaaatcaaagaatatcaaaatgacttaactgattaagcctgaagttttacagaaatataaaatgaaatcccttttaactttagcaatggagtagaggtaaaatacagttgtaataacttattttttaaccctatactataatgtattatattttacaaaaacagtgactgtgacacatcagaatctatgtaatagtcaaatggtttctaacgatcaagaaatacactgggagatgaatgtcaagaagccattacttccacataaaatattttaccaccacgaggctttgaaatgcaaaataaatcacaggtactatttctaaattatctgccatcagaaccatcagtccactggattctgaactgcagtcacagctcttcttggactttatataatttgacaacagtgtacagttctaaacatgtataaataaacagaatatcaaagcagcagaaaaaaattggcttttgttaagtactaatctaactgtgcttgggattaaaatggcgtaatttctaattctcatgaaaatataaggcaaaaattctattatcactattcaacatttactaagcatgccctcaatgcccatctaacaaaaactttttagaagatagaaattacatataaaatataagatgcttgagatgcttccatactacttattttcaaaataagccaaattatatatgagtgtacccatctacatgctcagtataatgaatgttctatgcacgcacatgctaacacaaaaggtaagaaattcttcaattgactcagagttccccaaatatggtatgtatgactaacagctgagaggaaatacaactgaaactgtctgctggaaatccattaaaatctaggcacagaaaaatgcctggttgatagtatagttggatgtgcaaatttatgcaggaatgtagccaaatctttggcaattccctcatggtcttagatttattaacaatagccctttctttttcagctgtaatgttacatttaaagaacattagtggagttggaggacctgcctggtctttaaaacaaatagactaaaggcttgggtatacagagtcatggaatttcaaatacaaacaaaaatttgcacaaaaaaagtatgctccacaaaagcttccatatgcaactctcaaaaatcagtaccttagaaaaaacaagcatactattttgcaattctttctacatttgcctttgaacgtattcattattttaaaaatttttctgcaaaaatgatttgtatcatcttctctgaaatgagtgttattaaaagacttcataggttaagacatatcctcttaatatactacttcacggatttattttcagtatttgcttgttgttaggagtaaattaagtacttaactcttacaagtcatttaacaaccacatttgattcttgttactctgtactgagccccttctatgctctcaattctgtggaatgttgtatcaaaaaatgaaagcatggtattttcttcttcaagagtttataattcaatatgagtacaagttaaacaaacgtattcattcaaaggcacaaatattctacaaccagttctgattagtgtgacaatataaaataaaattgttgaccattttgaaggaaaagttctgtaatttttcaggagaacaataataagaggtaaaattgacacaatactttgcagtttaagaaatgattctcattgaattccctgaatcctcaga

SEQ ID NO: 1232 - DNA, 2646 bp, Homo sapiens
aatggaagtaaagagaaagttcaaaaaatgattcacaagatagctcaagcgataaggtccctgatttcaaggatgtatacatatgtttgaataaaattgtttcaagaaatctgaggttcaaaaggcaatatttctaaatatactggaagcattctaaaacaagctagagtactatagtaataagcatggttctttatagttttcctgttctgggtttctaatgcttttctcaagacagaggtaattaaaataatatattaccatcaaaatctatgttaggtcttctgatgggatttcctgtggtttcctcaagtcaccgacatctcagtacatatttgaatatatccattacatatctcaatgtgtttaaacctattaagaatgatctccctcctgtttgtcttcttcctccacaacatatatgaatacaagattccttgcaattaatacaaatttcttccttaaacttaataatgttttcttagcagatttctctgatccaaaaaaagtaatttgcaaggaatatgaaatagaaaacaacttcaggtttatagactggagacccataattcatattatttgttatgttttcatcttttctgaaaatacagattttaaatacttgtaaaaaataaatgggatgtttgttttaaattctgcctcaatccaaatacctggaaagccctgtatttcgaaaacttgaaatttcattctaattttatttaaggttaaacatagaagtgtgctttaaaagttcacatctatctcccttaacttgggctgtacaaattgtcccaaagatttacatagttattatggcatttttttgatgcacaaggaaccaataggtgataatttatctcatagcagcaggatagatgagcccagctcacactgggcacttactgagcaatgtcctacttgctgaaaatggaatcttataaaagttgggctgtttctaaaatgtccatgggcattctaaacctgtagtctgagccagatgtctggaagctcttagagatgatttttattttttctaatacagtcatatctttccctttgctgttttctttgcacttatctgtcttgtcttattttggtttggttccttctgtccctgctgtaaacagaagtatgtcctttcttctccctctcaatttattgacttttctttttcttttcttttttttttttttgagcatatgtgagcatacagcatctgtttccaagcctataccagatggatgaaaataattattggagaaatctgagaaaaggaagatcaaggcacttttaacatcagcagaagataatgaaagggtagaacaaaaattgaaaaccagagacactgtcaggagtaaactaaagccacttctcagagtttccatagatccaatggcactgccataaatctagattgagaaagtccattagcagttattgcagatacagttaccttctcctcaccccaaattctaaataaaatatatcaaaataaatgaacagattggttattatttaaatattaacccaatttgccagcttcttttaggtcgtaaatttgcatggactcatggtaatccaaatgactgtataaccaatcaggatatttaggaaaaaaaaaaaaagaatcagtggcaatactcaagcccaggttccatgccatctgcaggagctgtgccaccgtttttattataaaagaaactactattaggatgcagtcggactggtttttccaagcactaaatccatatgggtagaactcaataaataccatgcacataataattactaacatctgtagagtgctttccggtctacatgttgctttgtttaaccttcataactgttataatcctcttttatagctcaggaaactgaggcttagggaggtaaagtgatctagttaagagcacacagcaaaaaacttttaaaccataaattttgactctataatgaagttttttgattccaaatccagagcttctgctaccttgtggtgcctctctgaaaatgttttaacaacaataatgttgtgattatacctttcaatgtaatttttagaaaatgttgccttttagtatcttccagccacagcagctaatattttatgaggtcatatttctgagttatttgtagtatggaaactgaacatttgaaaacattattgaaatctatttaaaaactgttatttggttaatttgtaaacctcaacctccttgcctcaagtgatccttccacctcagcctcccgagtagctgggactaaagacatgcaccaccatgcctggctagtttttgtagagacagggttttgtcatgttgcctaggctggtttcaaagagtttgtagtgattttgaaagcgaaagcaagctagataaagcctactttatgaaacatgtgcttggaataaaatagattaggatttaaacccataataataaagagccacgccacctctccttatagggaatatttaatatattcccctagaacataaagagttaattgttaatcacttaacaggaagactaggagaaggggttctacgacattaaaagcaaaaatgggaagaaatgttttaaataaactagaaatcggtgggaccacacattcacttaataaatctttactggccatttacta

SEQ ID NO: 1233 - DNA, 1295 bp, Homo sapiens
agctacagaaaccttgaagagaatttactccaacttcctaattttcctaaattgaaataccgacagccagacaattaagaattctgtcttagatcacatagggaaaacagaaatacaataataattacatttaggtttcctgatttcaagtttaatatctttataatctcaacacagtgaagatcagcaggtgacttatgttttcttcatctgtgtagggctgatttcttacatgatttttctttttaaattctgaaattaagtatttttgttaagtatgatcttattgtgttaaaagggaaattttaattcaatgtttattttgtagaaatacctaattttcattaaatattaattactggatgaaaatgatcacctcttcttccagcttctaaagcataaggtttgttagtgctacacagctgtagaaatttaaataactggcatgtggagacagggtgaagtttagccttttcaagcaggttttttttttctcttagcactgacatattgtctcatcaacacatctaggagcttctatttttgaaatgcttcacttatcacctgtggagtgttgaaatggaacctattttttccccaaagagaacattctttagcaaagacagattgtctcttctgcattaaggaactgtccctcatgaaatactctattgagacaagctcatgctttctgcctacaaaacttgatttttaaaaaatcgaactttttcttaatccttgaatgataatttacattagaagcaaataatttaactctttggatatacatttcttacaaattataattttttacttaagacaatgtcatatttcacaaaaagatgacttaagagagatgggaaatgtacaaacaaactgacgattgagactgcaggtaaaactttccttgggtagttagtgtccccaccaaccccaggccaaaaataaatttcattagagattttgtaccacataaaggaattatgttaaatttgagggaggtacaaatggcaagactctggacgaactctagcaacagatgaaatctagcaaggggagttgccgtctcttggcatggaaatggcctgaagtaaagcacagctgctagtcaggagcaagctcaggctctgacagcagagtccaggctcaaatctcagatgaactttctcctgcctggtcacattgtactagtcactctaccactaaaattctcagtgtatgtgtttgtgtttatatacaaaatgagaagaataatggcaaataacctggtgatttggggagcattgaatgtgctt

SEQ ID NO: 1234 - DNA, 2507 bp, Homo sapiens
ttcctctgatgtttgacaccgtgggcaaatcagaactgagggcttctgcttgagcttccttaaacaaaaaaaaagcatttttttagactgtgagccaggcacttaaccagtatagctcttccaaagaattccagaagtaactcttagcttcttgaattgggaaaaaaaaaatatctaatttataagacaagtcataagctctaactaaaaccttaccttaggaaattatccctggaagctactgcataatattttgttatacaaaaccccagtttcaaaagaaaaatcttccttaattagaagaaaccttagtgtagatattgaaaatggactctcctgaaactcctaagggagcaacatctcaactcatattcttttattgattcaaatagccgtgacctccagcataattgtggtcatgctccgtgtaacagagtcaattgcttttgaatcacctcttcacttaaggtaatcatgaatgatgccagacatgtgtttctcctcatgatgttaacaaaaattccagattaaaaaaaaatgtgaaaggaagaggcatgagacgtgcctgttttggagttgtccccccaggtaggcccacattttattgctttggcaggaccagtcagagccatgattgacatataatgaggctcctattcaggtaccatctgaaaagcctattctaatctcacagtcctgagttgctcctcatgccagttcctctgttaaactgacacaaagttatcatctgatagtgttaacttggctgaaaaatcttcaaatgttcccgtttttcctagaaaaaagttcaaagtcctcaacctgatgttcaaatcctgatgcggtttggctctttggctctttcctgactggagtctgtctatttttatttatttatttatttttttgagacggagtttcactcttttgcccaggctagagtacagtaaagggatctaggctcgctgcaacctctgtcccccgggttcacgcgattctcctgcctcagcctcctgagtagctgggattataggcgccgggcactacaccaagctaaattttgtatttttagtagagacggggtttcgccatgttggccaggctggtctcaaactcctgacctcaggtggtccacctgcctgaggctcccaaagtgctgggattacaagcatgagccaccacacctggcctgtctcctaatgtattgccctcccctggtaccctcgtacggtttcctgtctaagcactccctgtgctcaccaacctcagctccttaattgaactgctcttactgtctgcaaggccctttactccatagacaaccatcaggtatcagttcttctaacaacttctccgaagacactttcttaaatttctctacacacaaaaatatcattttctctccatgtcatatagtatttattaatgctatgaatttataaaacatattgcaggataccttatagtggtttttaaaatgtgttcatcttccccactgcttcataatccagaacaagattattttatatcttaaacacatttatagtatcttttacaacttccttccagtacctctccaccaaaggactagccaagagctttgcatattgttctattaaaaatatttgctacttagttaaataatcattgcttagctgcttctgatgatacttttctatgcataaattttaaagacagtttagagtgttacttgaatacacaagagatactctgattcataaaaaagcatgtctgtgaaaaatatgcttgaaaaactttctactcccaactgattccctgcaaagcacagtttttccaaaactgtagaagacctgactgcttggaatacattgtgctgatttacttaaatgccatttctcttcagtgtctggtttttttaaaataccatttaaaataattatgccaaaatgtgtacagactataccaaaatataaaagggagtaaagtgaaaattgactctaccatccccacgtttatctcccattcctccttcctagaggcaacgttaccagtttcctatgtattcttacattgatttctctttcttttaagaattgatcatggttttctgttttaaaattagatgtttactagatgtgaaagatacactgctttcccttagttcatgtgactatcagtaaacccctaaaagcttcaaatatgatctgaaaaacaagggagttctcagagtgatgctctatatctttgtcttcattgtctatgttcacacatatacaattagaggatctttaccctcttacagaatatctgtagcagacaaaataacaaaaatgaaattatcttttgaaaggctacaatgtagccaatgtatcactatatgaggcaatctccatgtattatgttaatacccacaacaaagagaggttattgcctctcatccacagacagatgtagattgaggtttaagattacaggactggccagtaactggaatgcaatttaccacaggtttattagatgccaat

SEQ ID NO: 1235 - DNA, 5534 bp, Homo sapiens
agcggggtgtagatgatgacaacatccattctactttagaacaaattcccaacttatcttgctttctctcctgtttatagtcaaataatagaatgaacactcatttcaaaatttcattaccagtggcactgttgcatgtttggaatgtcgtctctttaaaatgacaaaactgtatgcaatttggagtagatttctccttgaacaacttttgataaactaggtagtatggtcttaacatatatgaaaaagtcattcttttttcttttttttttttttgagaaaaagtcattcttgtaaatcatttaaatgggtacgatgtacacactggtatttagagtttctgttttaattctttttaaataaactatcatttaatcttaaaaaaacgatatgcaaatccagctctcacaaacaagtacaagccagcttcagcacaccactgtttaaactctatcatcacccccaaaattttaatcactcccttttctgtggtctcaagcacattattcgtttgacttctgtgtatgggagaatactatgatgagctcaatacatgactatttcccacagtaaaatgtgaactccctaaagtcaggaataattacccatgtcacccatttttaacacaatagttttcttctgaatatagctagcaactagagtaagcactatatataaatacaaatgataaagagataagccaaagaaaagggaaataatattgaccaaccgtaaagaaaacgatcttttaaaatcacaaatgaagaacggaggaggaggagaaagatgaagaaaaggaaaacaggaagaggagaaaaaagaagtgaaggagaaagagaggaaaagatggtagagaaaaagcccatagaagcttctgaatataacagtgtcctacaatatgatcccttttcaaagtatttaaactgtgcacaccatgtaaatttcactggtggtctttatttaaattgctataaattgatatgtatctatcattgattaaaggcaaagtgtcagccccatttatttttattttatgtaaaggaaaattatgttcatttttctcaacatgtcattgtaaaagctcacatggtgagaaactttacttgtgggaactttcacttctgggtgaaaattaaatgcttaattaaaatgatttttattggccctctgtaacactcacctttctgaaaagggttgtcatatattgcaacacttacaatgaaaaaggctaattctccagtctaaaaatatttccatcctgctttaatgatggtttaataaagaaaggaacatatatattattcagcatttaaataaaatgtggcttaacctttaagcagaagtttttcatattttttaaatttttttctttggaactaaaataagacatattgcattgatttaatattcacatacctgaaaaaaatgtttgccctactccctgggggcaaaatcatttttaaaattagaaatgagtagttatgactttacacagtattcttgtcttttgaatatgttccagtcatctacttctatttaaaaaccactccaaattaaagtggtttaaaacaacaacaatcattttattatcttttatagtttccttgggccaagaatttagagtaggctcatctgggtggttctggcttagggcctctcctgtattgcatgtattatacaaggacttagaactttctgagttttacaaagaatattttagtcctatctagcccttaaatctttgtcctaaagcccgtttttgaaaacagtttgttgtctgaaatgaccgctctgaaccttttccattttctataaattccactcaaaacagaataatttgttcttttgttcatcaccctcctttcattttgtcatgggcagtaagaagccagattgatccttcaacattccacctggaaatctcataagctggagaaccactgagttcattaggcacatgttctacgttctacattcatacaggcaagaattttgctaaattttctgtcactacataacaagggttctcttttttctaacttcctgttacattttcttcactttgcattaagccctcacagacagccttcaagatccgttaggcttctgctaacactctcctcaagatccttcgagctctcactgacaccctcccgaggtactttgggatttcactaagtctcttctaaaggattctgtccactgcccagtggacaagcccataggttttgttatgttagcactccatttctgcatcaaatctgctccattagtctactgctacatgatgaatcacaccaaaaggtagtcacttaaaacaacaactatcattgttatctttcattatttctgtaggtcagaaattcagaaaggggtccacttatggttctgactgagagttgctcatttgcagtccacagtaggtggagctggaacaatggacagctgaatcagctgggctaatgacagctaatgtttctctgtccatgcagattctatgcttctctatgtggtctctctatgtggactaatttggacttcctcacagcacagcagtgccagggcagctgatcagcatacatagtctgacttcctctggaggaagcatcctaggagagccagatagaatcttatggcttgttctgagttagtatcagaattcatgcaaagtcacctcaactgcattctatttgtaggagcagttgtaatcccacccaaattcaagatgagggaaagaattaaactccaccttttaatggggaagcaggacaggatttattttgcaaccattttttgaaaatataatctgctacataattatacttttcaactttgttctgtatggtttcattttctagctgtttctaggcaagaagtaaaatacaccattagtcattggaacaggatctccgttggggctgggggaaggggccatgtttttaccatgacttcaagattatggattcataatcctgattgctaaatgaaatcaggctttcagtgtatactttaaatggaaaccatgctttcttttcttgaaaatgtatatttataaatataattattttgttattctgccaagaaatgctagaatatagtgctgttatataccttagttcctctacaatgaatggtattaaatatcaaacatttatttcttcccttatttgtcatacacatataaagctgtcttttaaataaatttatcaacatgccaaataacatcattagtcatatctggttgatggggttaaaaatcatttttatcttttcctaaactttttttacattgactaaatctagtgaaaactattacttgtattattggaatggaatccatactcttttcaatttaaccttatctctctgtatcatatgttaacatgattacaattttgaagattatattttcagtgattctaacacttcaaatgtcaataaatattgccataacacataattaagagaaagataactatatggaaataaaatttaatgaacactttgatacatcgagtgccatacatccacacataattcactcctgcactaaagaagtgtgaataaaacaatacagtactccctagaaagagggacccatccatcgtacaaagtgtaattcatgattctgtggcagtttggggaagcaggccttcataacctacttccactatccaaacaaaaccacatttgcatttaccactgccgaacagacatgatcacataatacaaatatctcgtctctgcctctgaataaagtgatcttttctggaatggaacatactctgaatttcttggaacagttcaattctaatcattgtgtctcataagtatgtttatatgtcttaatttgcattggggaaaataattcccatactacaggtcttccatgctaacatctccagcaagtcctatgacaacacacaaccataggtccaggtgaacatttaactcagcaacctcaaagtaggaagaccatagattttggagtcagaaacaccagtgttcacattcctaccagatcacatattttccctgggatctttagaaaattacttctctctgagcccctttccttgcttgtataatagtatatggtataatatacctacctcagagactagatttggggaatccatgcaaggatataaggtgtatgatacatgagttacctagaagctggttttcagtagtgaaggtttagctttatttacttggattcttgcagggctctaaagaaatggcaagaaaaaagagaaagtgtaagtataaatgaggtggagagagggttttttcttgaaataactttgtttgccttcaaagcaatagtttatttccccaagaaacaaagactcctcggaatcaggctgctaagggactgttttagctctatgagaacaggacctggattccaaccctgacctttgtacagctgactagttaggggttcatacccattctaatgcaaacacatgaaaacaattaaacagccaaattccaggcagacttctcaatactatggcttatttaactcttagcaggggatactgctgtggccaaaaaaacctggtttaccacagagtgatgtctgaagaaaatataaaatcgtatcaacaagtttgttacaaaccacatcttgacaatagaataaagtctgaatataccattggtggtgtgtatgtgtaccttctgcataatgatgtctaccctagaagattgaagtggaagataaaaatagcctagataatttgagcaagaggaataataataaaacctgctacttattcaggaaggaaaaaaaggtgattgttctaatatttgaattttattaactcaaatagtttgaacactcagttctcatttacagataattttctaaccttccaccttcttttatctgttttaacacagctcaatattatggaattggcagatcaagattttcaaaagacatcagccactgagtctcaaaacttcacattaaatccaactaaaaaatacaagtagtattttattatttttattgctataaacaaagatagactcctttctaaaagatatagtagttgcatctccagataatcaaaatggtgatgcatttttaattatataaaattagaacattttgtatccaggtatcatggagcaatagggatattgatttaaggtaaagtttatgtctgcagaaataaaatggtatactttaaagctttgtgtcatatttgtgacttttcattcattataaagttacctgtgtgatataagtaaagtttgtctccagattataagaaattactaaataaaaatacaaatgtaaagaaatgaacactatgaatgtttaaaaagatagtctttcctttagaaatctcagattatgacagttcaacatattcaaaaccatgaagattattgacttcatgtaattttcatatcatagtgtttttaggtacattatttttaagttattatattctttcctaaagtagaatagataatgtattcttagacatagtattttctgaggacagaaaaca

SEQ ID NO: 1236 - DNA, 2194 bp, Homo sapiens
aagaacacactgggatcatgacaatattcacagatgccacatttataactctggaatggcatccatggagaccatgtaaatgtcaccccctaaagttgtgcagtgcacaatgtgtatgaccatatgctgaggccctaatgtttttatgggaaatctgccatcacttgtatttctattctgatgctgagtcttaatatgcagtcttactttgatttttgtttcccaaatagcttcaaaattgtaataccttaagttcttctccaaattggaagtagagaatgttgtcatactgacatgagaagcattataaaaaccagtcttaaatgagccatctcatgttgtcatttcatttgcttaaagagtcagtgtctgggtctacatatgtaaattatattaactgaactggagagctgcaaaaatagttgaatttaaggaactatatttactcaagcatataataacagctaatcaattcaactattttaaaacgtcttagaaatatgtcacatacagacattatatgtactggtatctatggggggaaatcataattattttcaagcatgcaagaaagaaacactacttcagtttatcaacttcaacagcttcctattagaatctcaggaaaactgctcgattattcctcttcttccacaggaccccattacaggccccacgggatctctccactattgctattgtgtcttaattttgttttaatcctattttcaatcctccaatccactccaatgtcagcaaagtgctgttgatcttgagaagtcctttgttgtaaatcccactgagccactttctgcagagaagctccccctttgaagacttgccccagtggtctttgtgttggctgcttcactgaaggaaaaagcagcatgccttaggtaaaaattttttgcagtgccttttcaaacagtatttgtacactttagtagtcatcacagagtctctgctgacctaaaagatttgcagctttataaaagctgtggcagatgctaagaatattcatcaacccttttcttcttttgaaacaggcccaaaaatgaatgacttgtgggcaaatattgatttcttttcccaaagatcaactattaagcatgaaagaacacctaaacacaaaatcgaaaggtttaccttgtcaaactaggacagaacgtagaccaccgcactttcctacctgaggacacaagggccagggaacaaatcagaaatgtaatgtctgtggcacttctctgtgagtcttctctggcaaccgaagctgaataaatgaagcaacataaagctgtgcttctccaacttaaactttaatgtgagtatcaattaccagggatcttattaaaatacagattctgattccctgggtctgggatagagtctggtattctgcatttctgactagcctccaggtgatactgattctgctcatctagggacctcgctttgagtagcaagtgtttaggccacttactagcaggaactaagcacagtatcctacaacagcaaatgtctttccaacaagaaagacgagagcaaatgctgatgccacatctgcactgcctcagaaaataaagaagggatgaggagcccccgagtggcactctgtgcccataaaaagatcacatccacatgagaaggattgagtgaggcaatggggttggtgcaaggagctcagcaatccctctgctatgcactgggggcacttggtttggttttcacattaccagcctcagcgaggtggaacagaggattacaaagggataatctaaatggcaattgcaagtgtattgctgtggtcaccagcaccttttccatcagtattttccatttctccaaagccatatggagcagttgatctatttgggtgatttcttaagagaaaatgaacaatacatggtcccgagtggtaagtgtagtgaaagttaaaaatgatattttcttttatcccaaagactccaaaatgttcacagatcttactattatcataaaaataaatgacaaaagggatttagttcagttagaaagcatcctgctattggccatgtagataaacttaaaataaaacacactgtcttctagccttcagcagcttctagccttcagcagcttctagccttgagcattgagataaaagtccaatatgaagtttcctaatgatttgaagagctagctgttttaacagaga

SEQ ID NO: 1237 - DNA, 2248 bp, Homo sapiens
acaacatttacatgaccacgagcacaacgaactcttctgctgtgcctgcttctttcaacatattcgtgctcaccatcaggactggtagaaactagagtttgtttacagccatatgggagaccgtgggttttttcctgagtgcgatcatggggcatgcatttgtgtgtgtctgtgtgtggtactcagctccaaggccttgtaacagagatgatgtatccccatcgaagaaaaatgacagtcagaataagaagacgaagccagtttgtcacttaatgcaaaggctgattgtgcggcaacaacagcctcacactgggattgattacaaacaagatgacacttccctgtgggctgcctcgcgtgttattataaataaataccattcgttttagaatctgcattactgcagaggatagattatacctcagcgccctaggtatacagtaaatatcccagggagtacaatggcccttctcaacccacaataggagcctcgcctcatgtgacacagtatcataaataaaatcaggccgtagcacagagccatgagaacagaagtgaagacagagtttgactgatgttagggattcatctccatgaagggcatgctttaaagtgtggtgggattttgttccaagcggcccaggggccctcagtagctgtaaggcatttttgatttatccctggcagtgaagcccaagagaaccgctcgatacctaagagtatttcctgaaaatcagagttcggttttcaagatgaaaataaatctgttaaatttttttgaatatctccttgcctttgtcccgactgttccaaatctgtcatcctacgatcttcaaataaataaattattttaaccaagaaatatagagcgactgttttctatttatttctttatgccttgcttcagtgcagggttgaatttgatctgcctgtgagaaatatatatttttcatttccggggctatccactcgttttctatcttcctctctccgtcttctcgacgtcttcctatctctgctatctttccttcataagcacggataggcgctgggaaggctcagccaatccccttttcaggtgtgacacgagtgccctctgccgtccagaatggcgaacaactcagcatccaggcaggttcagaccagacgaggagatggggaaaaaacctacagccgttctcccatctctgggcaaacactggacgtattgttaaaatgaataatttattaaaccacaattgtttattgactgctctttcactatctgctttccagttattaaacacattcgcggggtgcttgggtgtcagcccttagccgacttgaagcttctttctgaggcaatgatgttcccagcccccttgcttctctccacacgagacattttcgatctcttttgtcaggtcagggtcaaactacagttgttctgagatgactttatcaattctcagttgatagactctaaatgaaaaaatgcctaccgccgccccgtcgctacttaagaaggagggttatttgtgtaatgttctgtcagtccagcaggatctgtgacagacgcaaagagtcaagtgaaataagggaaaagaagtttttatgcctcttattagtctctcttccttacatcaaggaactgatgacatccatcctaggatgtccttccaaactgaaagaggcacgggaagaaccgtccctcactcctttcggagtaagcaagacccgctttaagtattcgtgctaattctccacccttcaccctgaggggattcaatgtccacagcagagcaggtgggagggggcccttgccaggaagaaaattctctcactccagatttgaaggaagcatcagtctgtacccagagtgccccctgcttttaaagggcaaacatttccaccatccagaattgcaagaaaatgtgcagtaacccaaaaataaatcaataaggcccaaggcaaaggaagaaacagagattcccaaaattgaaagtgagattttattctaaaacccaaaatttttaaaaatatttgattgatactgatactagacataagcacaagaaagctttcaccattccctctctctctctctatctcctaaaataagacaatcatttcatttccaaataactcattagggatttgtgtttaaatgcagagacctattgccagatgttgccaaaataaaaaagaaaaaccctaacagtaaataaaatcagaaatgtcatcaaattattcctttccccaaactata

SEQ ID NO: 1238 - DNA, 2951 bp, Homo sapiens
tgtcatttatttgagtctatttttgtgaggggaaaaataaatccctaatagcaactgcacaaattcctgaggctgccacagtattagttgtggtttaaaatatttgacattcatattaaatgttaaatgctatccattatataacaaatagtatttttttctcctgaaaactttattttaaaagtaaaaaaacaaaaagaacagtaataaccaggatgttaatagtaaaatccaatttctaccaaaattttaatgttaacttaaaaccttctaaaagataggaaaagttttcaaatatcttacacttcccacccacagattagcatttaagttataaaactgtacaaagtaaatgtttagtttttcagtatagatacttatatggacatcaccctatacatgaaaagttaactagtggtagaataaataagtttcactatcatatttcaataccatttggtacatctaagattaaccaaatttatatttctgatagttgtagatcaaaaattctaaaaattacaacaacttgtcaaacagtattacttatatattattgctgtaactgaaatatattgtaccagtttcccagccagattttttagaagttgaaacaaacccacaaataaagagaacttaagcaaaacctcaaattttggagttctgcccagagtttctgaatttacttattaaatgcagcagagctgctggaaatcatccaaaatctggagaagagcaaagagacaactggggtagaagtctgtctgctttcctcaagaacatgagagcctctgatgtcagtcccgaaaaactttgatacactggatatcaggtgtgcatctgacattcctgagatgaaaaattttcatgtgttctatcatagattagcaaaacaagcttactaacgcctgcagtttttatggttcataaaatgctttacctatgttttttcctacctttttattttgcttcttctgcattgaaaaaaaatcagaattcaaagtaccaagctacttgggggctaataaattaattcaagtagcttcaaaatggtatcagaatctattacgagctgagtgaatatgtaaagagatgtaaaaggataagacatgaatttagattgagtagtcaacattcatgaagaattagtatcacaagcactttaaaaaatgtttcatttacattctatcatccatttgtcataattttaaacatatttttctaaccagtaatggttaataatctagcttggcagaggagtaaaatcattttcagtgaatttaaagattatagttccaaagttatactccagaaagaataaatcaggaacaacagaaaccttggtgaagagtggagcaggaggacaaccctgcaggtgaggggttgtaaacacaagagcagcgggagatggggctgggtgtaattagtgaggaatggtggggcctgtggcaaactagagagaacatgccctgccccgggcaattgaattcaatgaaaataaaacaaaaggccaaaagcaaccccaaaaacctgtgctggccaaataaaacacagctgtgaactgctggccccacctccctaccaggactgccggtttgccccctctgctatggagtctgcgattttgccttttggacactctgccctcgctgctgccattgtgtgccacctgccattgcctgcctttcagcctcttggtgactgctcttaggggagcaggaatgacactggaggtaaagttccaagccatcggttttagtcctagctcatagaggatactcaacatatcacacttacgtgcctccgttttgtcaactttagaatagggctatcaatctcccagggtaattttaagcattaaattagataatatatggaaaaacactttgcaaattgcaaggtgccaaacacaggtaaagcaggatgttacccatgtcaccactgtgtcccctcttcctgctttgatcactacctgattccagcttactttccgtagacccagtcctctctgctggaaacaacagctcttcatacgcattcggaaatcctgagccccttggctagtcttggcccttttctccaaatgactttactgatcactgccccttctcccacacctctgtttcaggggcccatggcaagggctgggcacagactggatactccaggttgtcactaggcactctctcctctgaagtccataccacctgccatggcatccttgcaggctcttaacatctggaacatttctcagtttcctcagtggccatttcatacggctcagagttttcctctccacattgtctcctgtcatctttctgggtctcgccctcatctgatgggagcttcctcaaattctttcccctctgttggaaaatgcctgtgctgttgtcaagagttaaactgccagacatccttgccaaagctaatcctgtcctctgttgtctcctctggcactttatgccactaacttctctcctcccatacttggttccagaagcccaaaacagcttctcatcaatttgcaagtccctggcatgctggcacctgcacgatgcctaatggtcaactccagtggccttctgtcggggttatcaactttctctgtggaggccatgctgttagtcacatgccttttgaaaactctcacctcgtggcttccaataccgtacactctcccagtttctccacctctctgacagttgtctctgtccctgcagcttctgccaccctcctgtaacacagctccactggctctctctggatgatggtaaccccactcaccattggaattatactacaattttctataaggataatttcaaatttatatctccatgctcatacctgtcttcacagtcccagtccccagttctccccatcttttggctgtttctatcaagactcagagttggtatcaaaaaattaacctatccaaaacagcactcatt

SEQ ID NO: 1239 - DNA, 1908 bp, Homo sapiens
tttcaactccacagtgtctccgacagcccagtttttgtttcagaatgattccacaatctatacaatgtgtaaaattactcatacaaagattactccctattatttgcatatgttaaggttcatgtgtgttatttattgcagcataggtctgaaataaattatggtttaaaaatatgttcctgataatacccttttcatatcacagcatgagggcaactggtgtgaaaggcttcccacttgtgatcaaaccatgcttccctttattttcaaggtcagctataacaagagttatgtctataactgagttagaaatggtttattgtagtaccttaactggctatcctcagtcacagatgatttttacttttcagttaataaatccagggttgaatttaatatccattggccctcctgagacacatatgcacaatcctaagaggacatctgtctcagagagcaaacatctctgccatcctcaaaactaaagtcgcattatggtcacgtgcagagcatttgttttgtgtcttttccattctctaaactttagagaatgctttagagtgtgagattgaacttttccctggaagagtaattgttcatgcaaatctgtgcccaatcttcacaaaaagtgtggaaaaaatatgcaagcagaagcagagaacagcaatgctcacagtccagattttaaaggtgatgcatagttaggtcggtgatttgaacactgctggagctttcagactgaaaaatcatcttcttatttcaatagtaatggcattaaggattctactacactactacaaatattgtacgcctcatgtcctgttagtctctaacaaaaacaacttgctattaaagtacagctctgggcaaaaaaaggtggtttggattgcaagaagttattaattaacatgacagcaaagcttcaggacatgaaaccacaaagcagctctctggctggttgtcaacagtgtcacacatatgtaaataatccacagttttaaaaggctgttttctcttctatactttatccccttgacaatgattgtaattttctgtactgagatctcttccaagtctaacatttgtgactacagaacagtatgaaagtaatcttggttccaattgtttctttttaaatctcataataataaaagcatcctagaaatgagctctgtcatattcttaaagacaactgagacaattgtcagtatatctatccactgtaatctcagctagcaggtaacaattaaattaaattaaatcaaatgttgtgggatattttaagccatttttaaagaacactacctttttgtcaacatattagaaagtcctcatttttcccctaaacttttggcatacacaacatttccaggaaactgttcattaagactaactgcaagagaaagactcattctctcaccaaaacgtctacaattaagttcattttataatagtaattttttaatgaactgctaacactgacggaagcataaagactttgtaaaactgccttggatatgaaaacccatattaaatatgtaggtttcagagatgaccccaccctgcccacaatacacaaacacacacacaaacacccacacatacacattcacatacacacacattcacatacacacacatatcacatcacacagagaataaaatctctcaattgacttcattagaataacatttcagttagaaaccaaatttgaaaatcattcaacagaaatgtatattttaagtaccagccaactcattttcattattaagtaaaattaatccatgtgaagtaaggggaagcaacacagtgcctcaccaagatgggagtgtccagggcctagttcagctgctgctcagctgtgtgaccctggataagctacagcacctccctgagcctacagaaat

SEQ ID NO: 1240 - DNA, 1783 bp, Homo sapiens
caggtaacgtggaaaagacaaggggaagagagtgaacaggggaacgcagagggcgtgagggaagaaagagagattctgctgcgagtgccagccttgggaacatcccttcttagtgaagttaaggaatgcccatttgcatccccaggaaataagaattaaagaggaaaagggggtcgtgcggtggctcatgcctgtaatctcagcactttggaggctgaggtgggatgatcccttgagcccaggagtttgagactaggctgggcaacattatgagacccccatcccaaaaaaaaataggaaagaaaattcagccaggtgtggtggtacacacttgtaggcccactactcaggaggctgaggcaggaggattgcttgagcccacaaggtcacgactgtagtgaagtgtaattgcgccactgcacttcagcctaggtgacagagtgagaccctgtctccaaaaaatgaaagaggaaaagggaagtgtggggagtggagaaataaatgaagaccaaagcaacgagaacagccagaggctatttattcagagcttgccatagcaatggagtcagccaccatcacttacgttctggcagagactcaaaggcaggcagggacatggaaaagcttcagagtggaaaaaagggaaggcgtcaggcgtggcctgatggaggctgtggcctggggaagctgcaggcgggctggctagaggcaggcatcctatgtggttagttaagcgggtatatttggctttctctggttggaagcagggataaaaattaggcgagctgtcagttattagtcaagtcctggccatttaggcagattgttatggggtagtggtctgtgcgcagcctggtgccctcccagcctgattggaagcactggcttcctggactgactgttggagacaatgggtttgctccttgcttgcagacaatgggtttgcaggttgctgcaggctgtgggtcagaatctgtttgcacacatggttgggcattgtctgttcccacattcagtctcttaacaggtcatcattgccatttttgtgctcttgacttatcttattttctccaacctgagttccagagctccctcctgagttccagaccctgggactgattggctcctgggtccagacaatttcaacaccccatcaattttacctcccaaatacctctccaatcaagcatttctgtccacccgcaccagccaatccaaaatcccctccccccaccgtccccgttggacctcagacacgtttccatgtgatctacttgctgtcaaccttgacattctctctggtttggaggagtccaactccaggaccaaatcccatgcgtggtcttccagcccaactgcaggcaattgcagtggctccacctgagaggcttcagggagggcagggggctgccctccccacctcagatgtggcactaagcctcactgcagcctggaggggttgcggtcaaggactcaccgcccctgcccactcagccagaccctacaggaatcttttcccggctggcgcctccattcagaggccaccttatgtggactggggctgggatcctgtccagcacctctgctgagacctcctctcaggaccgtccaagacacttcccactccagcccagggctccccacatctccactcctagccctttccctccctccctgggtccccacatccataaaatgtcgagtctttgctgacactccctgggcagtgaaaggggccaccccagctgactcccccagtccctctggccctagcctggcgctg

SEQ ID NO: 1241 - DNA, 2395 bp, Homo sapiens
aggaagcattcagccgctaaatccagatttggaaaaaaaaaaaaaatggttcttgctactgtcacaaaaccagcagaggatgataagaatggaggtgcctggatggtaaaacttccggaaatgcctacctatgtgcctactcaagatgcgccttggaatcatggagccctggcaaacaaaacaaaacccttcagtcagaacgtgggaaggctgcaggcagcctcactcccccgggactgctcccatcatcctcactgggcgccacggagtccagagggtggttttcctgagctgagcagtaattagacctctgcttctcaactgagttcctctgtgtggaacatactggaaatgtgtcatcagcacctccatcaaagttgcgatgagcagtgtgaaaatcccccacatctggctgctgcacacgcacagacaccaggaaggtgagcacttccacacagagaaggaaatgcggcttacacagcagtgcgagacagatcagaaagctgtggactcacaaatgctgccccgaaccaaagctgtccctcagctctagggctaccttcattctgtgttctcactcacaaacgcaatgtgtcctgaccaactgcggttctcaatttcttgcaaagaacctaattaaataatggatacatttcaaaccaaccaaccaaccaagcctgggtgcttcttgcagaaagcttccagccctttttgctggatgggagcccagtcctcactgctgcgagaggagcaggggcagaaacaatgagtgctgtccccagctgcccccagccaggcctccaggcccaactcctgctgcacctagggggccgccaccatgggctcccagggacacacgcttgctgcccaagggcagtgtgagcagaagggcctactccctgcaggcttcaggagaacaaaggccctgattcagggctgcagtttcctgctgctgctagcagaaggctgcaggccgggctctcctacccaggcaacatcacacttctggctttcttcactgagtccccaataaataggaggctttgagctgcaaaatgtgatgctgtatttcatgaaaccccagagaccccaaatgactgcccctgtgcttctgaggggtttcttaagggtagtgtgtttccaggatgagttacaataccttttgtcccacaagcgagacacttttgcatatgtgccactctggttcggcccgcgaggctgtagcgggggctgacacgtggtatttttgtggggagtcattgccatttgctttgactgagacttttcggagggctttgctgtcaaattttcactgcgcctgcacggtcagtaaataccctcttccagcctccttccaggctaaaaaccagtgtggaaaagtttagtcgtgtgtttgacgcaactgcatctcgttgctatggaaacccaggctgctacataaacctaattctatattcctctggcttatcccacttttcactagcaattttaaaggagattttcaccttccctgggtattaacctttgacttggagacactagagtggctttgtggattgtagaatatccgtatgcaagaactcacaaaaccacatccaaaacagccatttcataggctgtggtctctcgacacggaggcccactcagccaagaagacaagctccgttgagtccttctccaagaaggaccaagagcaccagagaagggccggccggcagccctgtgatgagaagcactctggtggcgcacccaagctgcaaggaccgtgtcatgatcgatgggcaatgcctgccacagacttgggggctgcagaggcacaggttcccccgaatcagacaccatatgtctacttcagagcaaagtgtattcagtcagttatttacttggactcctaaagcaagatggtagtagaagttctttctgaccctcctagagcacaggacccttctagaatcaggttcctctggtcttgggcctggtgtctcattccttttatttgggtcaagacatgtgcttctgttgagcatttgacacagaccactaagagcgagccctgatatgaaatgggggcctattctgcctagagcaggggcagagcctgtctgatttccctctcctgaaactggggactctaggaggactcattaggaatgtttttgttgttacgtaagtgaaggaaagctgacttgaattagctcaggcaaaggttgagagtaaatggtagtgataccccaccaaaaaagtcctgtggaatcccctgctacagcctcaggggctggacaacaagcacacatgcaaagtcgtcttgcctggcacacaaaggtgttataaatcattctggaaatacatcacccttaagaaacccttcaaaagcacaggggtagtaatttggagt

SEQ ID NO: 1242 - DNA, 5970 bp, Homo sapiens
aagggaagtagcttcctcaaggtcttaagcgacttaagctaccaagcggtagaggcataattggctaatgctaaacagtaccctgagggacagaaaggatatttatgttttatcaacttcatcattagtaacacaattgtgggactgaacaatgaaatgttttatgaactttcactttgctgcttagagagaaaaatacaaggtaaatgcgtcggagatgtacgctattagttccactcgaaggatcacttgaaaggaccctgcgttgatcactaccatatatcatcagcaactggggcaaactatgatgcgtgtgtggagaggggatagggagagtgggagagatctcatcatcctaaagccttatttggtttcaggttacaaaatatataaacaaattccattgggaagatagcttcatcgctacagtaagcatgaggtgtcatctctgcaggcagtaggtgcctgtaaccttgtgtagctgccatgggcctcctactaagcgagagtcatgtcagctcttgggaaggagacacacagaaggagaaggattcttatatcacccggggtattgctcctgtcacaaaaggattcttaggaccacagtgatagctccacaaaggtgcaggcaaaaaaactggctgagactgtaaactcaaataactaatatttctattatgtttaacgagatgaaagtgtagttttataggccaaattcagtcaagtatcatcatttccatatagtttaacgtgtgtgtgtttgtgtgtgtgtgtgtgtgtgtgtgtgtaattaagacatacatccaaaagttgtttctgggaactgattccaaaagtgaggcttggcaggctttgggtaagctatcacctctaaattatcttcatcacttttaaaatggaactatgacatactgtgatgtatatttaaaactgtgcaaaagaaaaataattccaacagaatctcctgtcttccaagtcctgcagtcctttaaattctgcacctaaaaatatgccacgtataacatgtagaatagcatttgtgtatattttgatggctaaatggataatcctttataggactatctatattaccccaggtatgggaggggacattaaataagggaccaggagccctgtgcctactagctgtatgaccttctctggacttcagttcacatctgtgtaaaacaaagataacttgcctcatggagtaacttgtgagtatgacatgacacgtaataaagtaagtgagagacccttacaattataaagtgttaaaaatgtggattaccacattttaataaagggcaagactgcagttcactgaagaatcatatctgtggtttgaaaggagctgaaatagttggcttccacttcttgcaagggtaggagagccatccacagacaggcttctgtgtggtgacaacgcaacacaaaggacaacatgcccgcgtgtgaaatcggttaatgtggtcagtgcagacagacccatctcagcactgcggccctggaagattatttcacgggtttaaatcattccaataggcttcatacagggatcaaattgattgggtaattataaatgcccatttcattattctggttgtgtagagagataattttgttgttattgttttggagacagggttttgctctgtcgcccaagctggagtgccgtggcacgaacacagttcattgcagtatcaaattcctggcctccagcagtcctccctccttggcctcccaaagggctggaattacaagcgtcagccactgcacccagcctacagagggagtttaagcccagctagtttgtatgggttttgtctctttgtatcttcagcacattaaagcaaagtcactttggtaaacagcaaacactcagatgatctgcttgtgtacactgcagtgactaagatgtagttgctgccctccaaggtctaacacctgggtctgagtggtggtgtccaaaagaccatcaaggtggctaaagagtagaaaggagagctttattgggatatcagtttgcaaaatgggaagagatggtctccagcatggacagaaggcgctctctctttgaagagggaaagggcaggctgggttttatgccttacagggtctgtatcacacaatagagtcagagatattcagcaaacttggggtaaaagctatacatgtttataaggggtgctgagcacatacacagtgcacatatgttgggagcagtccccccaaaatctggccataaactggccccaaaactggccataaacaaaatctctgcagcactgtggcatgttcatgatggccataaagcccaggctggaaggttgtgggtttaggggaatgagggcaaggaacacctggcccgcccagggcagaaaaccgcttaaaggcattcttaagccacaaacaatagcatgagcgatctctgccttaaggacatgctcctgctacagttaattagcccaacctattcctttaattgggcccatcccttcttttcccataagggatacttttagttaatttaatatctatagaaacaatgctaatgactggcttgctgttaataaatacgtgggtaaatctctgttcggggctctcagctctgaaggctgtgagacccctgatttcccacttcacacctctatatttctgtatgtgtgtctttaattcctctagcgccgctgggttagggtctccccgaccgagctggtcttggcaacatacatacatataacatatatcgcatgttcactttgtggtggtgttttaccattaaaatgaggtggggccaggcacggtggctcacgcctgtaatcccaacactttgggaggccgaggtgggcagatcacctgaggtcaggagttcgagaccagcctgaccaccatggcaaagcctcgtctctactaaaaatacaaaaattagctgggcgtggtggcgggtccctgtaatcccagctactctggaagctaaggcaggagaatcgcttgaactctggaggcggaggttgcagtgagccgagatcgtgccgctgcactccagcctgggcgacagagcaagactccctctcaaaaaaaaaaaaaaataataataaaataaaaaatagaatgtgagcagcaggacggaggaaataggacacattctgtagaaaatagggagacaccctacaggccttcaagcaggaaagtaacacttcaaaggaatgcagaccgagatgaaggtctatttcctcccaccagcactggtgccaagtccaatgcctgattttttttttttttttttttttttttttttttttttacagagtctcactctgtcgcccggctggagtgcaggggcacgatctcggctcagtgcaacctttacctccaggattcaagctattctcctgcctcagcctcccaagtagctgggtccacaggcccccgccaccacacccggctaattttttttgtattttcagtagagacagggtttcaccatgttgaccaggctggtctcgaactcctgacctcgcaatttgcagtctcccaaagtgctggaattacaggggtgaaccaccgcgcccagccgattttttttttctaattttagattccgagatacatgtgcaggtttgttacctgggtatatcgcatgatgctgaggtttgggcttttattgaacccattaaccaaatagtgaacatggtacccgataggtcgtttttcagctgttggccccctcccccgcttgccacttttggcgcccaagtgctcattgttcccatctgtgtgtccacaggttcccaatcttcagctcagacttacaagtgagaacatgcaggatctggttttctgttcctggtgctaattggcttaggacatggcctctagctgcatccatgttgcggctaaggtcaagattttgttcctttttatggctgagtacctggtgattttttaaaagaaaagtttgctgaactgaaccaattcacactgaggcctgcacggtggggcttctggaagcagcactcttgcggaggctgcgaccaggacccagttggaggcgcctgggtgtagcgcctaggcagggagaagccccggaggacgaggcctctgaccggccgcagcactcagttcccggcaccgcggtgaggaccgcgcccgcgccacgcgcgccgaaaggactccgcgagctcctgcaggtaacgggctcggtgcagtccggagcccagaccaggcagttgctgagttatgtccgggcgagatcggtgtccttcagggtgggaggctcagaaacccagcgcgcgagcctctgggcagtggtaagggcgggttgggagtcgggttcggcgagtccaaaggaggctcccgggctgcagaggccccggcaggctgtctccgccccacgagccccttctcctgcggtctcctggactgcggcgacgaagcgtcggggctggggctccagtcgcctggggatgcgctgcgcgcccagggcggcttcggggccctgaggcgggactgagggtgcgggagggcggaagggggcgcggacgctccggaactcacggtccgggctgaaccagggcttggaagaccctcgggaaagtacgggcgttctgtgtccgggatgtgtgctgcgggtcggactgggggttaggttgagaagggggcactaagatttactttattttattttattttattttattacttatttatttattgagacagagtctctctcttgtcgcccaggctggagtgcagtggcgcgatctccgctcactgcaagctccgcctcccgggttcacgccattctcctgcctcagcctcctgagtagctgggactacaggcgcccaccaccacgcccggctaatttttttgtattttttgtaaagatggggtctcgccatgttggccaggctagtctcgaactcctgggctcaagagatcctcccgcctcggccacccaaagtgccaggattccaggcgtgagccccgcgccctccccttgcggagattcggcctggaaagctccgcggctctggccggcaccggtttccttcccgcctccccgcactcccacccccgctcctagttcagagcgctggtggcgttacccacagccgcggaatcccctttactgttcccggaggagctgcgaggtggaactggccgcgcggtgggggctttccccggccccgggacgagcactcagcgtcccctccccgcgacgctccctcggaatcccggggaagagcgcagcagaggcggggaggaggcgcgagcggaggggaccgacttccaccgcacctgggtgtcgccagccccgcctggccctcggcgccgggaccccgacgcaccccgcgcatagcgactggtggcctggtgggggactgcgcctgcgaggccttcttcgcgcagagatatcggggttctctgaaccccagaaatgggcctggcaggggaaggaagctgcaagaaaggagttaatctgcaggatgctcaattctttctatgacaaatcgcttcactccccgctcggcaggtcagagctaggggtgaccgagttacgccgcgggcgctgcctgagcaacgctttctaccgcggtcctagtgtctccgctccctggaaataaatactgagcgctgactgcatacctctttatgcggctcgcggagaacagttaaacaggtccctgcacgaggccgttctagttagtatgtccctatgacgcctttgtctgctactcaggttgaatgtcccgtttgtatcttagtggacttggcggatggtaggcgcatgtttagccttagtggacactaccaaatggctttccaaagtaccattttatttttctgccagcaatgtgggagaattccagttgttccgcgttcttaccagcacttggcgttctgtctgttttaattttagcattctggagtgtgtagtggtatctcactgttcttgtttaggt

SEQ ID NO: 1243 - DNA, 2352 bp, Homo sapiens
aatagatcttggaatcaggtagactttaattcaagccccagctatgccagttattaacttatgtgacattgggaaaggctctcaaatttagttttgcaaaatcagaataatataggtagccaacaaatagggtttaatggaggtaataatgaaggtgattaagatgataaaattaaataatgaatataaagtgcttagcatgtaataaattttattgtatgatttcaaagcacatgctttacctacagtgctataaagctgcttgcaatagtcaaagctaatagaagctctagtcagagctaatagaagccttgtgtatataattatttaagaattctgtaaatatacataatagggtaggaatgagaaaatctttagaggaaatattcaaatatgcttggtttctagcaaatccagatagaccgttttggcaacaaccaagtcataattttaagtcttgttataggagctagaattttattcaaggggcaactgatttgattagataagatgctgtggactgcatgtttgcatcaacaaatgcacatgttgaaactctaacaatagaatggcattagaaggaggacctttgggaagtaatttggttttgatgaggatggagttcccacgatggggttagcatcctaataagaagagaaggagactagagccctcttctctcagccatgtgaagatacaacaagaacacctgcaaaccagtaagaaggccttcaccagacactggctctgctggcccagattttaatctttgatttctcagaactgtgagaaacaagtatgtgctgtttaagccactcagtctacagttgtttgtaacagcagcctgagcagacaaagacatagggttccttttattttcagaattcggtttagctgtaatcacctaccatcctgaaatgctgtttcctccttctgcccttgaaatataagctctgggactacagcttcatggacaaattctgaagaatttgtctctgctcctgtgggatgctaacctaatcaatcaaggaatgtttgctcaatggaatgaaacatcttaatgcagcttgccagccaatatctgcagagcacacctcatgggttctggctggcttggatttctgagactacttcatcctacccatcagactgtggactcagattcagccagaaggcctgattctagcgtcagttttgcctttgggatataaatgcatgccctacttcactgaacatgaaaccctgaatatttggccattactctggcaattgccctccctccctgtgccaattgccagtcaacccaactcccaggcagccttggcagttatgtctgctcggcctgctgtagcagccaatgacttagtaaaagtcagaacatagatctgctagctcccagtccaggatttccccttaactcatccatgtatatattaaacaactaggcttgcttttaaattctttttcatttagcctcttcttagaactgatcattttgagaatcctgacctgccaatattccataatctttctaaaagtgacacagcaaatacgacgcatgcacagtgctaactgcagctgatttcatttttccatcatctataaagcacataaggtaatttctaaaccagcagtaaaatctatttataaagaatgctgatttgttttctgcactttccaacacagagcttcaatttatttccttaccataaaaaaaccattactttttaaaacaatcatagttagtatattttataaatgttttaatttttgtaaagtccaacttgcaaattggagtgtaaatagctttcttaaaatggaaggaaccgtgttagacccagtatgctgactgatttcactgtgcttcaaagcagacgatttcacagtcattcggtaatgagtttttataaagcaattgatatcactaaaaatataattataataaataaaattataggaaaaaggaaatcttcattcagacaatgccaaattttttaactcattgctaaaagattatgtttgtacatgaaaaattttacacattctttctatgagataaacctgataacaccttgaaaacttaatagttatggaaaaggaactactgtgatattttttagagaatgtcgtgttcttgatgttcttgagtgagctgtctcatgttattagaagggaaacagcaccaccttgtggggaaacaacaccaccttgtggacaaacaaagaaagtgaatgaaattttagggccgggtgcttaatcccagcacttttgggagacctgggaggagggtaacttgagcccaagagttcaagaccagcctgggcaacacaatgacacacccatctttaccaa

SEQ ID NO: 1244 - DNA, 2857 bp, Homo sapiens
ttccgggtacatacccaaaagcactgaaagcagggtcttgaacagatatttgtataccgatgtccatagcaacattatttgcaatagccaaaacatggagactacccgagtgtccttcaatgtataaacagtccacaaaatggggtctaaatatacaatggaatattattcagccttaaaaatgaactcagtttttacacacactacaagatgggcaaaccttgaggacattatactaagtgaaatgagccaggcgccaaaggataaacacactttatgacttcatgtacatgagacgcctagagcattgaaattcatagagaaagtagaatagtggtttccaggggcagagaatgaagggttgttgtttaatgaatatagagtttcaattggggaagatgaaagttctagagatacatagtggcaatggttgcacaacagtgtgaatatacttagtgctgaggcttggacaatgagtaagaccaattccttggcctttaaggagcttcttgtccggtggagaaggcaggtgatttaaaaagtaagcatagtaggccgggcatggtggctcatgcctgtaatcccagcactttgggaggccgaggtgggtggatcatgaggtcaagaggtcaagaccatcttggccaacatggtgaaatcccgtctctactaaaaatacaaaaattagctgggtgtggtggtgtgcacctgtagtcccagccacttgggaggctgaggccggagaatcgcttgaacctaggaggcagaggttgcagtgagctgagatcgcaccactgcactccagcctggtgacagagtgagacttcatccccctcaaaataatgtaagcatagtaacatgtgatgagaggcaggcgtgcagaggacaggcaacataaagtggtcacactgatatgagaggctgggaagccgaaagagagtcaggggtgtccagagaaaaggttggagagtggggtggagggaggggtgtgggtgcgggagatgacgcagtgccctatgggccaggctaaggaatacatacttgatcctgaaggcaagtagggccactggagagttttacactaaagaatgaattagaagccttgctttgggtgccacaaggagaatggattgaaggaggagagaaggtgggaagagtttgtattaggagccaggatggaatctgtgtttatctccaacattcctcgtctgctttctaccatacacaacgctttctagaatgtcaggggttagacttgtttccccacctatcgtgtcactaatactcaagaatgctaagccctcgccaggtgcttcatgaatcccatgggccagcctcggtctgacttagcgttgaacttcccagaggacttggagtgacagagcacaggccctgcataggccctgcatgcattttggatgtgtggcactaagcatgcactgagaagtagaaacgaaaggccatcgtcatttgtctttgggaaaggctctctgctgctgagtttttaaaataagcttcatggcagttgctgcaggattcgaatgtcacaactgtagtgagggaactggggaaatgaaaactagaaagggggtgtcaaagctgttgtaacttgatttgggagctgagacactgacagtccgatttgcattttgcaaaattctgacagatcctcacatgcccacctcattctctgctggggtttatcacatccatttcccctagagtcctccataaagaatttaggtctagaaggcttcatgtagaatccagttattatcagcattaagatctgggttccaggagaacatgaattgctctctgtttagtagctcagagctgtaagagggagctctttactgtggaatgctatcaccggcccaccctagtgatgtggcacccacccacttacagaccagccaaattgctgctaatcactcagaactgaagagtcctcatagaggtcaccatctcactgcaagatagggaaactgaggcccgggaaagagatggataggcatgagtcactgggacggccaatcgttaactgggaaaatatttactaagctcctaccacgtgctggggcacttgggatttaagcggcaagtaaaatactggtcttcttgttgactagagagctcatacactcccatttcttgtcaaacgagccttggtttggatttaagttggtatccatttatattttatggtaagaaacctatgctaatcaatgccttattctgtttcagaaactatgtttggtattttgcaaccattaccttgttcaatttttgtcaaacaaagagatatatatttatcatccacgttctacagatggggaaattgagctcaaagagccacattgtcttgcccaaggtagcagagatggtgaagtgctgagctgggattagaacttatgtcagcctgtcttcaaacccttgattcttcatcctaatcctgtgtcgctggccagcagatcttcatatcattaagctaaaccctctgaattttgcatattacttggcctccaggtggtggaagccccaaaactcttcactgaataggaacaaggagtccccaggtcccatgaaaattatttctgcaggaggagttgggaaccccttttcctctacttccctcccgtgtggaccccttagagtcaggaaaagacagagctggtatctgcaccaggacagttggctgaataacatcagcctgatgcctaccatttactactctgtgccagacactgtgctaaggggtttccatgcaccaacccttaaatcctcacaacaccactgtgagatgggttctgtcattctccctgtattgaaattgagaaaacggaggcatagagag

SEQ ID NO: 1245 - DNA, 4460 bp, Homo sapiens
cgtggcctttgcgcctctgtgtgggtgcacatgcgctccctccatctccgtgggctttgcgtctctgtgtgggtgcacatgccctccctcctccctccatctccgtggcctttgcgtctctgtgtgggtgcacatgcgctccctccatctccgtggcctttgcgtctctgtgtgggtgcacatgcgctccctccatctccgtggcctttgcgtctctgtgtgggtgcacatgcgctccctccatctctgtggcctttgcgtctctgagcgggtgcacatgccctccctccatctctgtggcctttgcgtctctgagtgggtgcacatgcgctccctccatctctgtggcctttgcgtctctgagtgggtgcacacgttctttttctatcttgatgggctctgcactctgtctgtgcacacgctcttgctccgtctttggtccagaaaactgtccctgtggaggtagttgaggctcagaagtggaataacgtgcctgatattggacagcacatggcagatttggggaacgtgtgtggatttggggcaccaagggctggagcagcgcaccacctcctcttttctggggtcaacagggccaatactggttctgtgcctgcaggatcatcctcattcctccacacatattcgcaaagacttcccagacctgaacacactacaaatgcttcagagactcttctataagtcatatacttttaacttaagtgctttaagcctgcctaaatcatgttgtcataaaactggagtaagtctatgagcctggatttgtagagcgtacatttctaaaactgtaagagactctactactttcccaggtggtgatagtctctaatatcatactaatcatcattttttaacattctagctcctgtatgaaaaaaaaaaagaagaaaaaaccctcaactatttaaatggcacatggaattttgatttatcataaatcagtaaataaatgtttctcagttgaagaaaagcaggttgtcatgatttcaggttccaactggaaaacaactctctgcctgagcattgagtagtttttttattttttattttattttttatcaattccttgctaacagagcttttctgcagagcaacacaccttcacggaatctcacatagcaagttccatttccagactgggcccgaaaaccagaagtctgagcccttcccatcagtgactcttcccagggtggaacatcatcccttgcagggctgccccagctctgtgttggcttcttccttcactggtgctgttacagcatccctgcacctccatcatgggttgtggatgcaatctgcatggtgcagtgcacatcacggccagcttgcaagggctgaggacatttttgcttctttgcatgttgtccagattccagtgtattgcaatgagaggaagtgattctcatagaattacagcctgggcaagcgtccttcctaccggcctgtgaggctgccctgcaagctgtgccttttcatagtctttctgccatcatcagcgatggcctgcctggctgccttttgcttgggaggagaaaacatacgcaagcatcattatttgatgtcttcttttatttttacctttttcagttccagtttaaagcaatagcacacaacatcagagatttatttttattggacaagataaaaactttggaaaattcccaataaaacatgacctacttatgtacacatacaagaatacaaacagaaaatgtgagaaataaccctgttctttaagaatttaaaaaatagtaggaattccactgcagcataccaaatatgataaaaactgcacacgtttgctttgaagcctgacaaagcctgagctcttcccaccacattactaagtcgctgtgtgctcttgttaaagtgaattgacttctctgagtcccaggctccatatcctgcctgtaagacttgaaatggatttatgagcagtttctcagaaaaacatctggcacaaactagatgtgtaacacatgaaagctgttatggttattctcctgccattggttagtctttttttctaaaaagagtatatagcggatacctagccttaatttgggttttaggttagccactcacatcttttctaatcataatctgttctcaaccattgaaaggaggaagtagaggagaaaataaagaataacaattggaatataaaagaaaggccaggacgggtgtggtggctcactcctgtgatcccagcaatctggggggccaaagtgggcagatcacctgaggtcaggagttcgagaccagcctggccaacatggcaaaaccccatctctactaaaactacaaaaattagctgggcatggtggtacacctgtaatcccagctacttggtaggctgaggcaggagaatctcctgaacccgggaggcggaggttgctgtgagtggagattgtgccactgcactccagcctgggcaacagagtgagacttggtctctggggtgggaaaaaaaaaagaaaagaaaagaagaaaagaaggaaaggccggtacgtgcaaagtggggaggggagacgtgtgggagcgtgagggtttgggaaggagccgacggggcagctgtagaggagtcaggagaaggcgggaggtgacactgacagggaagacagacgtgagacaccttcctcccttacggttgggcccggccacctgtcctgcgactgcatcggctccttgtctgcatcccacagaagaacccacaggtgaaaaaggtcccaggcgaaggggatttcattcccaagtcggtgcttcccaggaactgggttaaatgctgctcagggccacctcccgggaagatgagactgggaagcttcatttaggtacattcaaaatctttcccgccaaggggtagaaaagcctgctgagttacagcttcccagagatggtctcctgctctctcagatgggtaatgtttcccatcggaaagaagaaagcagccagcaggagagggagaaacgagccagtccagccatggcgccattccagggacgtctttttgcttttgtggtgttaaaacatcagccttcctcatttaagttttaaaatgaattaaaaatgtattaaaatgctaggtaaatagcacaaaaatgtccaatagtgctctgttttcctttcgaaaattggtcgtctgtgtcgtatttattccagcagcttccagttcatacgcagaaactcactcttaacagcagatatctcagacctggcaagaacatgagcattttcctccaggcaaaagattttaaagactgaaatgtcttcttaatagacacacagcatcagtgctctcgagactctttcccctcatcgttagataaataaatatgcatcgccaatttttgtttttaaattaaaatctcttgtttctagtggtttataatttgtatattgccagacactcctgtttaggatcaaaactgaaggtctggaactggaagcattaagacactaaatgtcacaagcgctccttcaaatgaggacttgttaaaattagcccttctccgggtgcacaggtgacttgctgaatttacctcagcaagcggccccgcatttgtaaaatcccactcccagccttggctacaaaacatccactaaaaatgataattaaaataattatagaagcaataggaaagcataataagagaaaaaacattttaaagaaattattcagaaaatattacaagctgatgctctggaaatattccagccctactaatggcatcttaatatgtgaaagtatttgtgtaattgttcagagatgaaagtctcctctgtttaaattcaatcacagtatgatatttttctttatttaaatgaagtaagcgtggcaattttcacaacataaaaaagatgcttagttttaatttaaggaagatgtgttgccacgtgctttcagcaaagttctcctgcatagagtgtcttccagaaacagcaattcctcccctatttccccaaattaaacaacttattgggcgtatttaaagtaagctttcataaattgagagaaatttttttttaactttcaaagacgctttacaaagtgcaacttaatccccccatctttctcgtaattttatcatttttactgaaatgttgtggatgtttcttggccacggtttgttgagctgtgctcagagcagagtggagggtggaaagccacgggccctgcagcagcccagcgagggagggcagacagaggggctggtttcgcatcctgagagggatccagcagcacctccgtgccatggcccctttgggcaattatccccagctctaactatggagcctgcggtcctgggctctgaaatcagagtctatgaacagaagagctctaggcaaaaacataccattcaatataatgactaatgactctgtggccccagcatgggaaagcagaccctccatcctgggctggctgcctgggtcct

SEQ ID NO: 1246 - DNA, 1883 bp, Homo sapiens
ctcctgggtcagaagaaaaggacagttcattgctcatggcaatggcaatggtcagagtatcagcatctgattcccacaagatgatcctaaggagggcacagtgacactttcacatgcagcaggttttgttacaggagaccaaccctgaacacagggaagccaaatcttctaacaatgcctgtctttgctgaggagggagacatgacctcagttctccaaggctgatcactgtccttgacaatgacccagaggaatggcagacactgccttgcagacacaccagggcccatggaaagctgttccacattccgtaattacgttcctccaatcacattgttccctagtgtctctgttttcattatagatctgtcagatcacatatcatgcgacatccaggtagctaaaatactgtaagtgagggacttagcaagggagtcaggctgaaaaaggttttcctttccccctagtctcttaattccttttggttcttggtttttccctcattacaaggcagatgctgaatggccaggactcaaagcttcttcctcataggagagaggcctcagtcagctgaaaggaggaagccagacacttatctgatgctgtaaaatacatgcttatggtgctctttggacaactgtgggtttgcctttgggaaacaacagtttctattatttgcaactctgtcaatgtcacctctttatattttattaaactcattgaaaaattcatatgtcagatcattcggttaaaacatttaaaggcctagtatctcatcatatgggggtttggcaccaattaatcttacaggaaatttggtttcccatccgtccttgtcctcccacttcagggtccacctgctggtggcctgggtttctccagaggcaggtcctcccagcatccacattccctcttctggaacactggggacaaaggctggagagcccaccaatagcactaccatgacctcctggcataaggagacagatgactgcggcttatgccttcaacactggctctttctgagtacgttttacacttgctggtgggggccacactaggaaaaaatttccctttgcattttccttccattcacaaagagtcagcccccagcatcaagacggagcagctgtccaaaattagatgctactgctctcatttgttggttaaaaatagctgttctgcaccttttatgccatcaccaggggctgttttcagccaatgtttatgacagagaaagacatttgctaattcgctgcttattcaaggagaatagaacttatttgttgttcccctgcaaatagacaactggggatgttagcagcaatttacttgcattttcttaggatttgcagggtggttttgtgataggaaaatggctagtgaggagagaggaaagaagggcacacattgaacctaatattttaaaagaagcaatgaaactgggcccagccagcgaggcagcctacggtgctggacacatctgataaaaggggaatcaccaaacttgccatttcaatggagtgaagcccaaaggagccggagcgcctcgaaggtttgcagtcctccctcccctctaacccccgaggccttgggttcgtccggagcgcctggaaggtttgcagtcccccctccccgccacccccgaggccttgggttcgtccggagcttctagaaggtttgcagtcccccctccccccaagccccgaggccttgggttcgtccggagcgtctagaagggtcccccctcccctccacccccgaagccttgggtccccagagcgcgcccagggctttttttttttttttttgagacggagtctcgctctgtcgcccaggcttgagtgccctggcgcaaccccggctcactgcaagctccgcct

SEQ ID NO: 1247 - DNA, 3526 bp, Homo sapiens
ttataaatatatataatataaatatgtcaagagtaggatatagaaataatagattctggcatccagataaactgttaagcgcaatttaaaaactagattataaatatttttttgctttcctctaaaatattgtgattcaaattctaatacggaagcattataaattatatattagattcaatctttttaaccttgtactataaccttgtactcatattatgaatagcctattatttgtaaatgttttcatttatttcacataaccacctttatatgtagttctgatctagaaaagtcgcagggaatgtcataggacgtataacattttgcaaaattaatgcattttgatcaacaatatgtaataattcatatggttggtgctactgcttaaaacctttatgctactgcctctggtgattttgggggaaattcagagagaactaaatgagcacttaagaatgaactttcaagtacctaaagaaaaggtctctgattataatgaatttctttttgaaggatttctagaattttagctccatcaacatttgaaaattttacggaaataaatctttagaaggaagaaggtaaagtgggaaacgaggggtggagacaggagggaaaggaaacacagtgaatccaatataatatttaccatcacaacgagtaaaaacagtgcacaattgtccatacttgtgtatgattagatagccttctatcatcatgagtgcatgaacaatgaaaaaatttaatgcttaaacagtatttacgtgaaagtccctgtgtctcacgtgtataatggcttaaatgctgagacacctgggaacactgagcaatcaaaaaatactcaaagaagttattttgtctcaacaacagcagcccaaaacacttccaaaacagaagataaacatatattttctctaaggtgcaataaaaaacttaaagggtagaaatgtaatatatctgatatatataaaaattcttattttgtatgaaaagaaaaaagtcctacccacaaagaaaaggaaacgaattgaggaaaatgtgatataaaaatagattattgcaaagcattggatggtgaaatctattatctggattccattctctttttattaattctgtaacttttgttatagtttaaggtatttttaaaattattcagccttcagtgtgctgaatccaatagagaaattaaacgtgtgaggaagacaagtggcacccctgacaatggtcacttgtgacaaggctggagattcatgtggacaaggaggccactaacctgggaagctaaattagtttatttccagttgtgcatttggattctatttgattctctgccgctatgtccaagaggcatttctagtgtttggctcatcgacccagagtcactgcagagtaaaagaaaagcttttgtatttgtatgtgttaccataccaagcattatcagcgaggtaatgatgaaatacccgcttccactcactgggcagctcgtcaccatggcaacagatcattatataaagttcatcaattcagctggtcattatcccaaagcagcagacagctaatatgttaaggaaagttctttctcttaacttgtaaacgagcaaatgaattaaattggtcttggcactgggagctcaatattacatttatatagaaaaggagaattcagagaagaaaaaaaggtcttcttggctagtgtatgcttgaaaaggagaatttaattcactcagttaccagattcaactaatggcttattttttccctgaaaaggatagtcagtcggtttaaactttcctggtcataaattaaaagcaaaattttaaaatcacaaagtattaatattttaaaccatattctcatagcctgaccctctgcatgtaagttctggagacccggcactaggggatgcagcctgccttgttcactgtgaccctgttggtttccagaacaaagcctggcacatagtaggtgctcaagcagagacatgttcattgtgtggcctctggggcacaacagcccaggttaaactccaggctcccacaatcacaggccgtgtgaccgagcgcagatccctcatatctctgttgccttctccccagtgcccagctcacagggtcggcggccactaagtgagtttaactgtatgtttgtttggatggtacctggtacacaggacacgttgtataagagtttgctgctattcttttcttattaatgtttagcttgtaaatgataagtcctattcaagttttgtctaaaatcagcaagatccctgctccaccactactcactgtacatatgccaggaggagaaatgacaactcttttacagctgctttggctgccttgctgaacaaaacctcaaaagctccttgcagtaccctaaatcataagccagcgcttataggaaatttaccactgcatttcctgtgaataaaaaccatattacttttaaaacaagagtgcaattaatagagccctctgggtatcctttctaaactctcatctaacccacagcttaaatataactccaatcattctgttaaggaagcaattcaagtttctgaaaggaaattacttgccttagatttattgtatctaaattacaaaacaaccacccagttggtaaggttggcagcccttctctgacagtcaccaggcaggcatccagagtctaaattaccctctagcccccagtggtgaaatttatactgtgtctggtcccattagttgtcaattgagatggttgagaaaaatctatgctaagcacttttgcacttttgaaacattaattctaaaggaaaaaaagagagctctcttactcagtggaataagaaaattattttgtcatttttctcagtggctacattacaccaattacgactagtgcctgatgttccaagctgtttgttagctcgttatgagctttctttaggcactgtcttatccatttctatgatttcaaagaaaacctgaggctgccattactgacctaaaccttcctctctggcttcaaagaaggatttccaaccaactctcaggcgtaccgcatgcaactagaactcagtatacccaaaactggaaactcaatgtctcccctttgtatcaaatctgtccatgcacctgaaatcctgaatccactggctaggatggaatagtcaatatgactatcctactgttcagcttcatctcctatctcttcacccacaattgcagctcatttcaatgtctccccctttccagaacaccccaggactttctagatctgcatgctttgcatattctgtgccctctccaccaggcagccatctccccatcccccaagagccagctctcaggcctctggtccgggtggagtgggaaccttttctcacctcccaggccagctcagtttttccaaagtctgtgtgcttatggaaggtattcttccttcaactaagatagtgcattaagtcaaaccaaagaataaatgtccatcttttatgggacataagctttccttggtgtgatatgctgagccttat

SEQ ID NO: 1248 - DNA, 1849 bp, Homo sapiens
aagaaagtacttggtcctaggcagttcaagtcacattattcattatgtagaaagctaatggccccaagcttctgttggtaaattattttttattgttttgttttgttccactgaagcgacagcagtctctgaaacaattctcctagtgactcagtgactagtttgtttaacaatatttgttaaaattgaaattacacagccggtagtcacaaaaaagaggcagggtggcaaaggttgtgcacatggtttaccaagtgtttcagattgcactgttaaaaatacacaaagtgttggaaaacactggtaactgtatgacccaataaaatcagcatagcagagcagttactgcttgtcttgaggtcaaaaagatgcgtactgtgactcaaattttattttaatcagacctttgaaagacaaatagcaaaaagctttaaataaaacaaattaagaactatgcgatcatggggtgagactgctttccattttagaacttttccagactgagtttagacagtatttagccttgttttagtcccttttgagtgaggattaagagactggttctcaagggcagggtgccaggtccaatttagcattagctggttcatagctaatgaatccattgattgaataatcactgactggcagaatctgatgggcttttcctaattagatgaaatctgtcaatgtgccactgcatatctatttgctatgtttctatacgggagaggtaaatatggtatacggttgttccactatcgaggaggatgctgtgctgatagtgctgtacactcactctctgctagtcctctgcacagagaaggatgtctttcagtttggcttctggttgggtttggccaatgggaggcaggagaaggagattgggggagggaggaaaaagagattatgacattgattccccgcttgctgctagactctgctggggatagttccttgatttcccttagggtctaagggtggtaagggcatctgtcttccactgcctgaataccacaacatgcgctgtttgttcccttaatcttgcccacctcttcataaatagtcccttaattaaattctgttcagttaaactcttttgaatagaatctatatctcatctggaacctaactaatatatatacacagagcaatttagatttttattttatgatcctctgaacacttaaaattcgcaatattgatgcccaaaatgatagttatctacccaatatgttaaaattattttcctagtttttactcagttacttcagtttcaaggtgactctgaatatgttaagggcaaatggttcttaagaataataatattctttatgtgactgtggttcagaatccttccgcatacaacttttgaatggtacttttatcaattgtttcttttttgttttgtttcttttcctttcttcaaagcaggatgaaggagctttcaaaagaaataatcaactaaaatcctaggagtcttcaataagataattcagtacgtgacaatataaagtgactaatctttctgaaaaataaatatttggtggttaccaaatatatgtggaaagaccatactggagcatttaacttccctattataaaccatttgtaggtaatttttgaatacatattgcaggcaaactaaagtgaaagctaaaaaatttctttccattttccttgtgtgtaacagagtttctcaactaagaaagctcagtactattatttgacttacagaaaaaaatatcatctatttatcccctctatttatctcttctggcatttatttatctttgactattttactttatattactttatctctgcattactattatcgtatgcatcttac

SEQ ID NO: 1249 - DNA, 1797 bp, Homo sapiens
gatagtttgtgtaaaaaatttagagtaaaatttccttcttagatgtggggggaaaatcctccaggaaactactgaaataaggaaggtaaggtggaattgtcagaacagctgcaatttaggaaatgggctgaaaccaatttcaacttcattttagcattcatcaagtcatacttattttagatgactttggttttggaggagtttcagaaaccatattccttatatgttcctttctgccttgaaaggctgcagccaattcacaacaatggaaacccaactggtacaaatgttcatttcaaatgtcttttacactagatagaaattggaacaaactagtcgtacaatagagtatatttttactaactcccatctagatggcatttaaggatatagtagcaaataatcttaaatgtctgctactctgtgttctaaagtttataaaaccaatgttttgagatttggcaattgactaaaatttagggtataatgaggccctttatttctagataaatttaggttgatttcatccaagcccagtagactggcgtatcagtcaagattctgccagagaaacagaatcagtgattgtggggtctggcaagtctgacgtccctagagcaggccgtcgggaagagccatctggagtctgtcaggccagagctgatgctgctgtctacaggcggaattttccttcctctgggaaacctcagttttgctctgaaggccttcatcagattggatgaggctcaaccagattattgaggataatctcctttctttaacatcaactgactgtagatgctaaccacatccacaaaataccttggcagcaacacctaggctagtgtttgatcaagtactggatactgtagccttgccatgttgacctataagactaaccattaccgctggtggtgaaaactcctcctcggtttgaacagaattatctgaaagtgttgctcggtgtatccactacaaatggcatcagtcctgaaggcctggactgcatggtctggcctccaactcctaaatggagtccttcttgtggagtgagagaagcccaggtcaggctgtccttgttctcttcgttcctaatactttgacaggggcatgagctcagggtgctagactctagggcacaactttcctatttttcatgaaggctgcacagaatgaatatctgcatcaatcaaccacttcattctttgtctctgctctggagaatgtcatgtggggaatggcctttaagaatttgcagtctgtgttcagttctaaagaatgcttattttaaaaatatatcaaaatgaatacaatttctgtaagtatggattctttacttacaagtatgtttccttatagaacaaagagaatgtgaaaaaagaatatggtcataaaactgtaaaatgtgcatttggccaaccaatatttaatttatttattattaattattttagagaggggggtctcacactgtcacccaggctggagtgcagtggcatgatgataactcactgcaacctcaaactcctgggctaaagtgatcctcttgccttagcctcccaagtagctagtactgcaggtgtgtgccaccactcccagctaatttgttgttgttgttttgtagagatgggggtcttactatgtttcctaggctggtcttgaactcttggcctcaaactatcctcccaccctggcttcccaaagtgccggaatcacaggtatgagccaccgtgtctggccctgatatttattttatagaaagttccattttttatagctggaacaattttaaatatg

SEQ ID NO: 1250 - DNA, 4668 bp, Homo sapiens
cagtagcttacaatgttttttcattaataccaaaactaaagaatacatttttcaaagcaacctagtatgcatatatatattcttatgtgtgtgtgtttaaaactctatatatatgaagcaaaattttcacaaaaaacaatatttaccctcattatacacaacacattctgatactacccattctatttaattttttaaaaaattggttctgactcaattaatttcacagcccacgccacaggttgcaagtgggggctctgggcaaagacatcctggccacaagacccgcccgctcttctaaccatatgactttggtcaagtaacttaacctttctgtgccccaagtctgttgcagtcttcattttatttcaagagtcattgagagaattaaacgagaaatcatttaatcatttatgtgatacttttagaactgagcctgagtcttagcagggggtcaataagtgctggcctgcttccctgtcattatctctgaaaggcctgtggaacaaaactgtctggcgctggggggtccttatgcccagaaatcaactctcaccatggagagatatctattcactctcctcctccctccatctgctccagtcacatgagctttccatgtcgtcaaacacgctccagactcactgtctttgcccttaatcattcttctgcctcgagtgctcttccctctaacatgcctatggctcctcacttcccagtctaatcaccctcccccagcttcccacctttactcagaaaagagttcacctcacaggctgaaggttgcctgtcctgagaaagccctgctcagaaggttggcactgcactggtatctgggaactcggctattaaacagtttcccatgctaatataaaacttcccctaaattataagggaggcttgctgtgtctaaattgcttgtataaataatgtgatttatgctggacacctgcttccttctgggggccagggatttgggtacatactaagcagagggtgtctacctgactggctcccagtaaaaatcctgggcactcagtatctcatgagcttcccttgtatcaacactttgcatgtgtcatgacaactcgttgctggaggcattaagtgcatcctaggtgactttcctggaaaaggactcttggagcttgacccagtttcctctggacttcaccccatgtgctggttccctttgctgattttgcttcacattttttactgtaataaatcttagccatgagtatgctaaatcctatgagtccttgcaaatcagtgggggagatcttcggagccacccacacacaagcctccatgcaaatatcaccaccttgaacagaccttcccggaccaccgtctctgtagcatcggtattctttaatcacaatcattctctatctcctcaactgctttactgaagagtagagcagatctcattccatttataaaataattgtattgtcttccctaccgaacataaactccatgaaggcattaggcactcagtatttgttgagcctccataatgtgccagataccatgccaggcactgaggacaccacagggaaaagacagataaaactccttccaaatggagcttacatttatgggaggagacacaaaatagatttgtttatttgtttaatatcagagggtggtgggcactaaaaaatataataaataagagtccggggataaaggatgggatggtgctatttcttctggggtggttagagaaggcctcttttgagagcatcacatctagaggcttggggagccatagtctaaccaggctaccttcccagaggaggtaatacatccacacttaacgggaagccctctaactaaattctgtatcatatgactagaaatcaacaaaattccaaaaggcattatccacaatagtcataatttaaacaaataaaaaattatttggcaaataagctaaaacttatttagcaaacaagctaaacttatatagcaaataagctaaaagtctttgggaagactttcattgaacagcacgccatgaccattacttagaattcaagaaaccaattattgggatttctttcatttaaaaaaaaatcaagaaagtcctcccaaaacttctcctacatctttacatgactagttagcatgtcccacaatagtacctagtcaccttgagactttagacacactgactttaaaaccaaaactatttgtacgtttctcaaagagaagagaaatggttcatctgaaatgtaaaacctccacctagtctagactaaagtgagtccatccaatgtaaaatggcagctctactgcttctccatctgtctaagtccagcttcaaccagagaatatcgacaagctttacagccatagaatcacagggcattagaactgggagggttgagagatcaccaagtaaaacaacgccccctccctggggttttgctattaaggagagtaatgcccagagagattttgctgaagttcacatgagcagtttacaaaccttaaacttcattctcctaattttaatccaaaaccttcaaggcaaggaacaagtttcttatctgataaataaacaaataaactcagaaagagccagtattgaatgacacatccttcaaaactggggagtcgtgcacttcctgaactggatccagactatccagggaataaggtaagaataaaggaaacagtcctccggccacaattagtcttccttttttccttgacagaaaacacccttatatcaaggttggagagagacagtctgggcagaccactgaagcaacgctgcagtgtctgatggagactgtatttccctaattctaaggaaggacagagacaaagtctagggtacatgttttccctctcacattttaacgtttctgaacatcctaatttgacaagtatatttaatatcataaagttgatattaagttgatggtgcatcttataattgatacttaggaactgaaagccgaacccaaaatggagcttcaattcctaaagagcctaagagtttactatttatcctttggttttctccttcgttggtcaactctagcgcttctccagtatctttctacatctcgacctccctattccctctcgtgcatttctctcatcctgcaattctgtaccatgtagccaaatgcccaaaccctctactgaggttcctgggtaaatccatacatgctgataacaactgctacagctctatcccataaaagccccttcagtagaagtaagaggcacagcagctttggtacttttctttttcttgctaataaagacaccctctgacaacctggatgcattgaaagagcttgagtcagtcgggaggagcagggaaaagtggcagagtgtgggggcaaaatgtcaggttcagacagacttggcatcaagtccacgcctcctttgttacctctctatgcctcggtgttcctgtagtataagtaaggttatgaatcatagaagtttccttagagggctgtgaaaatgacaccagttacagaagaggcccggtacttggtaagcacacaataaatgtaaacttctataactgtatttaataacaattgacacctaaaattcctctttgtagctgccaacctatttcccagatcactttgcagggagggttcaggaggcattactacaacacgaatctgtgggatagggagatgtggctgaaaacagtggggcagcctaaattgtgaccagctggaacagaccatcccagattacctaagaagtaactgtggagtcaaatgataacgtgacaagttcttaaggtataaacactataaatttttcacttaaaatatagagactgaataatgaatcaagctctaagataactaaaagcactaaaaagcctatttctagatccaattgttttgaacaaataaaaacccttacgatttttaaccatgtaaagtgcactagttacattagcctctggggggctcctggctatgcctgccaatcatttaattgaccttagggtgctttataaattaagatcaaaggtttactgcttcgtatttctttgctattctccctgctgtcatcctgtctctccctgtcacctacttggccaccactctcaccaaagactgttttcctgtctgtatcaccaccacccagagatggtgcatctgctgttccaatctgtagcttggtggtctagatcatccttgcaacttagaaaataacttttgagatctattgggttagaataatactagccctaaccattgttttgttaattaaaatggtccatttttaacatcctccacaatagccccccaaaaaaagcacagtaaagaaagcggggtcacagatttctcaaaatagaagtcaggagaccctacaaccaaccagttatagcaccttaggctgcacagtactccctgggttctagtttcctcacctgtaaaacaaggttagggataacatttggtcttctttttaactgagggattatacataaaaaatattatattatattagtatatgcatactcattatacatttataaatacatatgaaaatagtatatatactatagaatacacaatacatagatgtgttcattatagatcagttgatctattatgttggtgccaaagtgattgtggtttttgccattattttcaatgacaaaaa

SEQ ID NO: 1251 - DNA, 2958 bp, Homo sapiens
gtctcaaaaaaaaaaaaaaaaaaatccaattcccttagtggcttcttcacaagcttccatttgaaaatcttttttaaattgcaagaaactatcttttctgaaacaaatatggtaattttcatataaattaatgattatagaaacatacagagaaataaaaatcacttggattctcaccatccagagctggtattctggtgtttatttgactaattccctaatgataaacatttgttcaataagatgcttctatttatttttattattatagacaaagctacagttaattttcttgacttatatataaatttctccttagaataaattcctttaaaaatgtgccaatttaagttactaccactgttttttgagtatgtgtttccatgaaaataggtattgtttaattttaaatttttacgaatatgacaggtaaaaagtatttcattatgttatttatttgcataatttctttagtagttagggtggatggacatcgttcatagtgcttattggctatatgcctttcttcttactagaactgcctttcctgctttttctattgcaatgtttttatttctattattgatgactaaaaaatcattgtttaaccagtttaataaacaaccaatgctataattactatttctcatttttcatatcatttttctcagattaaggcattttgctatatttgtcattttaaattttcatatggataaatatgctttactaaaatgctttttgacatttatgccatgcttaacaaggcctctatgcttcaagagtacacaaatatttccttattgaattttcacatagatgacttcactttttaaatttaaatcttttgtccacctggaatttattctgatgaagggacataacactgccctaagagtccctttgcattatgtatttcctaggttatattttctgtcttccaggcgttgatctttgtttttcctactgttttatttaacctttcaacctacagactcctaatttcaagaaaatcacatttacttttcagctgctacggtctaagtcaaacaaagctacacttaaaacatgtaacatagaaaagtttactacaatgtgatcggaaaaggaagagggtatcacttgttccttatcctaccaattctgtttttctttttgtgctaaaaacagtagagacaagtggccattgattgacacagaaggtaaaattacaacataataaaatatgtatcaggtacaaaaaaaatctagtctaataatgaaatggtcaaacagtcaaaatgtcacaagtaattaggtggttcaaaatatacatggaatgctgagttgtgtttctgggtcaacaaaatgccaagtttcatattactttctacagtaattaactaaatcatttacattaattaattaattaattgtttttgagacagtcttgctctttagctgaggctggagtgtagtggcgtgatctcagctcactgcaacctccgcctcctgagttcaagtgattctcatgcctcagtctcccaagtagctgggattacaggcgtgtgtcaccatgccagactaatttttgtatttttagtagagacagggtttcgccatgttgcccagactggtctcgaactcctggcctcaagtgatccgcccaccttggcctccaaagtgctgggattacaggtgtgagccactgcaactggccaatcactacatttaaatggaaccttttacgttctcttgaaagttgctacattggtgtgattataatgctgatcaggaaacgtatgtatgtatgtatgtatgtatgttgagacggagtctcgttttgttgcccaggctggagtgcagtggcacgatcttggctcactgcaacctctgcctcctgggttcaagcaattctcttgcctcagcctcccgagtggctgggattacagacgccaccacatgcctgggtaatctttgtatttttagtagagatggggttttaccatgttggccaggctgatctcgaggaaactgatttttaaaaaaccccagttgctatagactcacaggaaaaaaaaaaacaaaaactgttactgtacttggatgctatcctgcacttttgtactagattatgagagtagaataaaataggagtagaaaactgaaataaatattcatactttcagaagcaatggctgatacttatcagagtatttatgagtattatgagataattgctgatgtaatgattaaagtctgtaccatgtaatgttatgtccgtactataaaagagaacaagggaagtcatcattatccataacttctttcctgtcaattgcccattaccccacattccagcatggctgtaaggcaaatacaacatagagatttcatctgtaggtcaattccagtctcttggtagtggttgccacattgctatattgagcaggattctgaggcagagtcacgactgctgaaatgagtcccaggaccaaagggtgatgcctgccaagagcaggtatcaactgtggcaggataaatgcaaattacatgccatatctataaaaacaccaatctgttctgcccctaaaccctttctagtcagcaagttcaaacacatatacctatgcacgtgacattccctaacctctattagggaaaaacagtatggcatactagtgaaaaatttggcctttaactctctggcgagctatttgctagctagctgtgtgtattttgaggcaagctacttaatattttctgattcttggttcttatctataaaatgagaataagagtattcactgaaagggctgtgtggggactcaatcagtaacatatgatcatgtggttagcagtcaacgaaaggtgctgctgctgctgctgctattatttctatgctgaggttttttgtgaggcccgttgtcttacagcatccccttccccagaaaaaaacccataaaaacccaaacaaac

SEQ ID NO: 1252 - DNA, 2111 bp, Homo sapiens
ggacagcaagacagttaaatatttaaaaatgttctaaagtaaaattcgagagtcttgtcctcagctgtttgaattgggcttactgtcactggctgtgaccttatacctcattcccaaggctatgggatctttactaagttaaattgcagagggcagactgcagtggtggctaaccaatgctatatctgcccttcagctcaagcccatctctacctgggaattttcggtgtgctcagacagcagagacagagacccatgcccaatgttgtcctgttgctggcaaagccaggtacaacaccagaggtgagagctctgtgttcatggatcaactgcattagaatcatggaatgcttccagagctagtgaatctaaaggcagggcccaggaatctgccataaacatgtttatatgacgattagtatcatgcattctgaagtctgagcaccattcgtatagaagaatggccaagagagtgaggattttaaaatgattcaaagctgatacaatagaaatgaatcactaaaacatattttactgcctttgtatttcagttttttttttttttttttttttttttttgagatggagtctcactctgtcatccaggctggagtgcagtggagtgatcttgactcattgcaacctctgcctcctgggttcaagtgatcctcctgcctcagcctcccaaatagctgggattacaagcatgcaccaccatgccccagtaagttttgtttttgtttttgttttaagtagatatggggttttaccatgttgaccgggctggtcttgaactcctgacctcaagtaatctgcctccccaaattgctgggattacaggtgtgagccaccgtgtccggcctcacaatatctttaattattaaatggccagcgctttttttttctccaaacttgtcattctgcaaaatcaggagatgtcactttaagttgcatcaagtactgtgagatagatatgactgatatgacaaattataaggtgacattcatcacatggaatccatggcctgaatgaaaggttaggaaaactatgggtttctaatgagaaagtcaagtttaattaattatcctctgaatagatttgcactggaggtttggcacctgaagcttaatagctaattacaagggctgccagtgaatagtgggtaatctgcatccccaatttcatgttggagatgtcataattgctgtatatcacaggacagcaaggcagagcaaatagatacaagctgcagctttctaaaggaattccatgatgctgctctgagagttggagaaaaggtcccagttgtcaaccacagactgcgatgaagtcagcagtttcaagtaatgcagtgtgtacccaattgcctttgaatcatggaaccagagagactaccgcatggcctctagctgatccccttccactaggccattgatgcatccagttatttcagactataccattttcccctatccttccaaacctatctgctattcagccagtttcctttagtagttagatatcaggcagggttcctgcaattcaccatatcgaaagaatttggcaaaattcaacaccccttcatgataaaatgttataatcaatcttgaatagaagaggactcaacttgagaaagggcatctacaaaatatttacaggtaacattgtacttaatgctacgaaacaatgttttcccctaatgtcaaaaaatcactttggttgcagaatgaagaatggcttgtggagagatgggtaaaagtcaatgatataattgcatctaggaagttatggcaatagttcaggtgaagatgacagcttagacttggatggcagcaatagaaatgagaggtatttgggaagatggggctcattcacagattggggattattcacaaattgagggagagatccaaacataactgctaggtattagcttactcggctggatggatggtgctgccattcattgggcagaaaaatcaggatgattttctctataccatggcccccaaaagtcaattagaaaagtctgatatctgtggaagatatccatattcaaaatggaggtgaggtattttcaagtacatgaaattgtgtttacatacacagg

SEQ ID NO: 1253 - DNA, 1764 bp, Homo sapiens
gaatgttataaaaagaggttcttgggagagtggacctgatggccagcaaaaatcatagctcacatttattgagttattatggctcaggcatgtgcacatattcttttatttaaatctacaatatgctttatcatgctcattttatacatgaggaacacaaggcatggagaggttagataacatgcctaagatcatgaagcaagcaagggggagaaaagatacccttctcactccttccagacagctcacttcaccaccactccccactgtctctaaagcaaaagttatttgaaggcttagggactggtttggtattatccatgcagggcggtttgttttgtttttcttttaaaatttcagcctatgcttaaaagatttcatgtaaaaattctgttttctagtttctcttgaaaattaagaagatctggtaaaactgggcttgaagaccattatggtaacaggctgctgaagctgaggagagggccccttcagatgggcataagcactgctccccctccccaaccccccttttaggttactatcagactctggaagcttctgaatgtgtgaaccctgaaagagtccatctaaagctaagttctccccaggggtagagcccaatgctgggcatacagtagggactcaatggatatttatcaaatgaatgaatacaggtggaattcagatccgtttggcctctcttttctgtgactggggaccactgaacctgagtcactaagtgataactcacaacacaaattttcttcttgttccaagcagccaggacccaggttctaggtatctaaaaatgctgtgcctgacttgagttcgcaatgacattttttatcaactgaaaatgtttacttctgtgcaaccagccaaagctgggggtaagcagcccagtggggtgcgctgattctatcttagattacgctgtgcacaatggactctttgtaaagtccttatggcggggagtggccaggcaggcatctcctgcacccagctctggagactcacttgccacaaagctgaagaaggacggggcagttttaatatacctggcttagaaaagccacagactgttggacttacatgtgggtgtgtaagccccacacagaagcagctttttctccagcattgttaacaaagctcatttagaggaatgcaagtctggggcacggcctggatgggcagcatgacgcacacaccacataagctccagacgctcactgatccccttcacagaggctgagcctgcccacccaaccctgccctcgccctcaccctcacctccgcagccggacctgggatagcactgcttttcttgagaggactgagtcttagcattgaggatgggaaggggagtgtaagggctcttccaggagagaatctcctgcttatttgcatggaggaagaagggagcctttcccagtgcctacacgtctgagtcccaattgtgagagaaaatgaattgcttaaagttgcagttctcaaccagaggtgattcccctcccaggggatatttgcaacacttggagggatttttcatggtaatgacttgggaggggaataagggaggtggtgctatgggcatctggtgagtggaggccagggatgctgctgagcatcctacaaagcataggacagcccctcatggcaaagcattactcaccccaaatgtcagtgtgccaaggtggagaaaccctgacttaaaggagggcttttattaccttttaagcttaagaattataaaaggcaatttat

SEQ ID NO: 1254 - DNA, 1800 bp, Homo sapiens
taaacctgctttccttgatctatcaactatgaaagtagttcatagtttgcagtgggccgagattgggccacagacagagtgagactctagctcaaaataaataaataagtatatatacacacacacatataaatacatatatatgtatccacatataacatatatatgttttatatatatatgttatatatatatatatatatatatatatatgtatatcctgctgtacctgggcatggtagcacacacctgtagtcctagctactcaggaggctgaggcagaaggatcacttgagcccaggagtttgaggttacagtgaaccatgattgctccactgcaccccaagctgggcagcagagtgagagcctgactctaaaaaatcctgcttttatggagcttattttctattaagatgatatcaaacaagataagcaggtaaaagatatgggatggtctaaggtaacaaaaaattagttggaaagggagatgttaagtgccaggtgttaaatttttagataacataatcaggaaagtctcactaaggaaggactttttgattaaaagcctagagaaagtgggggaagatggggaagaacattccaagtcgagggaagagcaaagactgtgagactatgaagagactgacctgtttgcagaacatggaagccaccctggctatagtgagaagctggggtcagggagaggatgatggctaagaaatcagatcacatagcccccaataaatcaagagggttgggggctgatgctttgaggattgattggagacatgtttagaagaaacttcatcggcatgtgaataagagagtgtgtgtgtctgtgtgtctgtgtgtgtctgtggcgggtgggtagtggtttgggaaaaggaggcaaagtgggtgactcccaaatttctgtcttgagcaaataagtgagtacagttcacaaatacagtggacactggagaaaaactggttgggtgagaaagataataatttaaaattgtaatatgggaaattttagttcttttgtttctcccacaggacacaacattattaggttatacaacatacacaaaaatgctaagttcaaaaacgaaagggaattctatatgtctatctttttaatggtactgtgtaagtatatttgtcaattagctaatacttattgagattctattatgtaacagacactgtgctaagtattataacacgttatcatgagaaatgtaagtaaaaattgtcagcaattagttgaatataaaggtccgttgctcagaaaagggacatgggaatcttcagcacatggtgataattgcagcctgcagtagattaagtcatctaggtgtggtggtggagaggggcaggccttagaactgagccctgaggagatctgtcattttgtgttctgatggaggaaaagctcacacaggaaatttacaaagagcttcgcaaaaaatgtggtgtcatggaatccaattgaagagagggtttcaagaaggaagaagtatcagctaatctttaaaaatgagagacaagcctggtgcagtggctcatgcctataatccaagcactttgggaggccaaggtgggaggattgcttgagcccaggagttccagaccagcctgggcaacatggtgaaatcctgtctcaaccaaaaatacaaaaattagccaggtgtggtggcgcgcatatgtagtcccagctccttgggaggcggaggtgggaagatggcttgagcctgggaggcagaggttgcagtgagctgagatcacacaactgcactccagtctgggtgacag

SEQ ID NO: 1255 - DNA, 1711 bp, Homo sapiens
taaaaagttttatttttaatcaattttaatcaggtgtaatttatatgcaataaaatttatacattttaagtgtatgagtcaatcaattttgacagatacacacatcaatataactaccacccaaattaagatctagaacatttcatcttcccaaaacgttctctttgcctttttgcagtggttttctccccacctccacctcccactccaagcaactactgttctgatttctgtcactataggatagtttagactgttttagaatttcacataagtggagtcagtacagtgcatacttttttgtgtccagctcgttttactcagcataatgcctatgcaattcacccatgttgttgagtgtatcagtagttcattcctttttctcactcagttgtattgcatcatatgcatataccaacatttgtttatttacttgctgaacatttgggtttccagcttttggctattttcattaaagttactaacatttgtgtactagtcttctcacagatctatattttcattttcttcacataattaggagtggaattgctggattatgtgggtaagtatatgttcactgtataagaaacagccaggccaggcacagtggttcacacctataatcccagcactttgggaggccaaggtgggaggactgcttgagcccagaagcttgagaccagcctgggcaacatagtgagaccctggctctaaaaaaaaaaacaaaaaaaccccaaaaagccagatgtggtggcacaagcctgtaggcctagctactcagaaggctgaggtgaaaggatggcttgagcccccgaggttgaggcttcagtgagccataattgtgcccctgcactccagcctgggtgacagaacaagaccctgtctcaaaaaaacaaaacaaaaaagtaacagctgaagtaggttttggagtagtagttaatttaccctcctctcagcagtgtgtgagagctgtagttgctccacattcttgctgactcttgtcagtcttttaaactttagctattatagttagtgtatggtgtcatgttttatttttaacttgctttttcttgatgactagtgatgttttcatgtgcctattggttattcatttatgtatctcttttgcccattttgagacttggattacttgtattttttagttataagaattctttatacattctgaataaaaatcctttgtcagttataggtattgtgaatatttactcccagtgtatggcctgccttttaattttcctgattatgaccttggaacaacagaaggttttaatttggtgaagtcagatgcattagtgtcttcttttatggttactagtgctttttgtatcttaagaaatctttgcctactccaacatcatgaacattttctcatattttattttagttctatagttttagcttttaattttaatatattaaatagttggatttaactttggggcatcatgatatgaggcagggattgaggttcctttttctttgtacgtttaccagttgtttccacactgtttatagaaaagacttttatatgcattgaattatgttgatgccaaaggcttcattttgtctttgtttttaattaatatttatttatttattttttttagagacagggtctcgctttttcgcccaggctggagtgcattggcacgatcatagctctctgcatccttgaactcctggg

SEQ ID NO: 1256 - DNA, 2636 bp, Homo sapiens
tatgttttaaataaatctgtctgtaatctttgcgatataggagaggacacggttgcacttccgaagaacagagctgggcacaaaaatgtagcctcttgaaacccattggcaccacttatactctctcctcagttctaacagatattaagatctaagttcagatgcattcccaagccatgtgcacctccaccagtgtgtcctaggaagccaactctctcccagacagtggagattccacagaaagttatcaaaagctagattcagatacactttgcacaacaaagtgcttgtgcttgattctattgaagccagtattaaattggtcttagactatttgaataaaaatgaagctcatgtttatctccagaaaggttctgactctattttttttttttaataagagaaactattagcatatttctagagaatgatcacataggcttctgacactgaggtggacctgcacctgggtccagagctgagctacactaggagagtcctcaggcatctgcacctcgcccttctgcatggcccatatttccctgatttttccagggtagcagaaggtacaacaatggtctgttgccctggaaacactgcaccgtggctagccacaggactttcttggcttgcgctggggagttggacaagccctacttgactgctgtcgttattaaacacaggaggagaaaatagtaaccattaagtgctttacaaaatgccctactgtttatacccatgtctgtcctcctagttgcctttaaggcccagggttgggacaaagtctatctttattttatgcattactgacagactaaagagagggcaaggagtgtgctggaaaggacactggattaaaagtcataagatttggttttagccacaaaccagttgtgtaacctttagcaagttacataaattaagcagttctcagtgttttcatgtgaaaaaaaaatgacctggtgatcctttggtttccttatgtctgtataaaagtatacagttctgtgtttctaagtggtggaagtggggtcagatggagtgacagaacgtcccttactaacacatgtatcattttcagggaaaggttaggctgtgctcatgtcatgctaaaattaaaatttcatccaatttcctggcgttttaatttcatgaagggcagaattggtgctcccatgtatatagatagatgagttgtggtaggtcagtctggaaaaatactctgcttccatctgacagtggccataagagatggggaaacagaggccagtcagttcatctcgtgtcagacttgaaagaccgcttgtgcatttatgcttaaaagagctgactcaggagtgctgtgacagcctttaacttagaattctcttatttttctggatttctgtctccttcttaatggtgttttaatgcagtttttgtgttcaattataatagtgttgctaaatacagtaggtctgattccacagaagaagaatagttttttcaaaatcagcattttcctgctgatttgccagctgtttcaataaatactcatctcccaacttcaaacgagtatattgcactcttactaaatataaatgccatccacagctactgtattctggcttttgagttctccacaaaatctgcactatgagggacccctttctcaactatgtgcaggtgattttgctgactcaggtgtcctgaagagtagtcggtgtttgtttttctagtcattgcttcccaatgtaaatgtctaagtataggcaggtgaattagaaccttctcctatggttttgtcatctctactagttctatctctgaaccacaagaaatgattagtcagggcagcctaaaattataataataatatcgtatctattttataactgttttttaaaatgactttgacctgcctgatgagataggataaaatatgaaataggctgcaagcataattgtttttcttttgacataatagaaaagtaagatatatgatttcggtataaggagcaggcattgttaaaataaactaaactgatagcatgtattatatgcaatataaactttgtactgttgtacactaatatagtaataaccctggctaaggaccagcaggaacataagactatattttcagccacacattgtttttctcacagtcctcattgaattgtatgtgtgcatttttcttatttttaatcagcattacaagaaatacaagtaattaagcctttcaatatctcctaacaatagtaaaaaggcagctatagtaattgcagtaagcatatttgttggtgtttgtatttagaaaaatactagttggtcttttatttgacagaaactgaagctggagaattgttacagaaacaaatgcaattcagaaacaaagttgcttcccttaaattttttttgttgcaattctacacttttgagtaaacatttctatccaaaagagcagtcaggttaattaaaggagagtaggaattgctgggttcttgggtactagcccccactgtttgagccttggattgataacaactctgtggtaactatgtgtccaccaccaccaggctgacaattttccaatcaaactgtttttaccatatcctcagacaatgaggaaaatgtgaggccctaaggtactgagc

SEQ ID NO: 1257 - DNA, 1879 bp, Homo sapiens
taatatataccataatatatgtggtaatataatctatatcaatcatttttgattgataatccctttcttggtaaaaagaaaattttcctctttacataaacttttagaattagttttagaaattaatattcaactcatagtttcacattgatatgctttcgctatgaggtttggttaattctgagtaatatctctgtttattatatggacagcatgttcgtgctatttttcccccttattattacccactgatatttttctagaagagacgtgcttttagagtgaaaagtataagtgtactaagtcaccaaattacagttttcattcatggtaggttcccctaaggtcacctctctcttttctgttttttgctgtagctctgctagatctatctacagatataacgctgtaaaatctggtccttttggatgatctataatgagttgattattaataaaagaagtcaacaataccttaacttcagttctgctattcagaaagctctgattatcaagggttattggagtcaaacttatttcatgacagaactcatctgcgctaagtgaggctattgataatatgtatcccaattagatggaatactttgcaaaagtgttaatgtgtttatcaggtgctactgggagtgttatggaatacatacgatatgcattgttaattacctttataagtttgagaaattgagagatgatatggtgtttatcaggacagtccctttcattacaaaacccggtatcattacctcattattattatttattattttgatgaagaaagccatagtacataagccatccaaaggaaaaattggtaggactgagatacgaaaattgtctttatgtataaaatagataatttgggtaaatatgcaaaaatttttctttcctgtgttcccaaatctcaggtaagagcaaggagaccaagccagtgtttgggagcagggaagtggttaaacagtgctgagcttggttgaatgcataaaacagtagaaatgtgctgtctagtaggtggcatataaaaataccagcttttcttgtcttccagagacaagtccttgtatctccaaatcactatttgcattactaaaaaggttactataaaatatttgaaaagttgccctttgtgtcacttaaagctaaaaatccttatgtaatagaaagagaaaatgttagtgaccatgagctaatactgattaataattgtacatgaaatgttattgagatgataataatacttgtgatcatatgaccacttatagtgacacttgttatattattgagaaacttctccccatatctctagaatatgcattgttatatattaattggacttgaatactcactagaaaaccaaccttgcagttgcgtaggaagcaatagtggccgagaatctgatttatccctccgtgagttgggattggaggaaaaggaatttatacaatgacctctactcctggactcatatgtagggactgtctaacatgtcaagtagcttatagagcttaattctttggagagtcaaggacttatttcatgctttttgactataaaactgatgaaactgatgattctacataaggtagccacaacctgaatagatgtcttacgctagccaaagtatatatggtgttgaacttcttttttatgacttctggataatgtgggagcaaagccatgtaccagatatttgctgcaaatccattttgccttttggatctgtatgatgatttcaggttctgggtgccatacattctcatgtctggtatattcccatcctattgacaggcaaaaacacagggcaaaaggagaagagagggcagatcttacactagcatgtcaatcaaggatattggtagaagcgt

SEQ ID NO: 1258 - DNA, 1317 bp, Homo sapiens
ttttcttcttcagctttgcccctcctgccactgtaccagacaatatccaggaaatcccctactactgacactcatcccatttccattgttttagagaaggaactagttgttgttgtttttttttccctgtctcagattatgtcatctattttggagtattttggtctaatgactttggctgcgatatggagctatctgacctttactgcacctggcagctctatctcctattttggggttgaggttaaagtgtcttctagttttgttgaagatagtttatgtttctcttcatatttgatgataattttttaaattaagacctaatttctccttcattttcaaactggatatcatttcttttgtggttaatattctttgacaagaaggaagaggaggaggaagaagaacaaaagaagcctgcctctctttagactgcccatctcaattatattttaaaaatgaagttaatatctgtcctgctaacagtagtgttgtcagaatcaaatgaaataatatttggtaaactataaagtgaagaccaaatttgaaggactatttgtttttgttgtaatagagttgtatatagtccagatgtcaaccaggcctcttcagcatttttatagtcaaagatgtacaagatagctcctaatgctcttttatggctgctcctgttgccagggcaacagcctgcctagtaacaatctaacagacaccccccaaaaaccaaaaaataaaggttattctagcatcttctccttttaaaaatctttaaaataagagaattcagttcttcccaaagcagtgtttaaaaaaaaaaagtatttaaataaaatcaaggataccatcccacccacctatcttacattttgtgtggtatgagtggcaccattgtgtgacccaggtaggatagtggatgtacagtttagatacccattttaaagcagttagaaagatgtaacttgacaaggaaagcagtctcttttgtcattctacatttagtgcttcaggagtacttgatatatggaaggatttttttaaaaaaaaggaaaaatgaatatgccttcagaaagttttttgctgcttttaaaagccatagatttgtcttaagttagtcaatgctgaatagaaagcttgatgataaaggtgggtgggtggatggatggatggatgaatgaaggaaaaattaggagaaaagagaaagcagaggaggggtgagacagagaacaaaagaacacaggctctactgttaacaaaaagcagcatcgctgatgtgtggggaataaattggaagtcatatcattacgacttttttttcat

SEQ ID NO: 1259 - DNA, 3333 bp, Homo sapiens
atgtggaactgaaaaaacaaagttgttattatagaagcagaaagtagaacaggggttaccaaagactggaaaggagggggaagaggaggacagagaaagattggtcaacaggcacaaagttacaattagaaggaataagttctggtgctctattgcactgtagagtgactatggttaatagtacggtattgtgtattacaaaatagctttgagtgttatcgccacaaagaaatgataaatatatgaaatgatagatatgctaaatgccctgattttataattatacaacatatatatgtatcaaacatcaaattttaccccataaatatgtacgattacaatgtgtcaataaaaatgaacaaaggtacatacagtattttaaaacaaaacaaaaatatataaaaacaccattatgtactaatgtggcatgagatccattcaatattattaatttaaataagcaagactgtaaggggagaagagaatatatttacatatatttgctaacatatgcacaaaatgtctttgaaattattcaccagaagtatcagttgcctctgcagagggtgatgcctggaggaccaaagtggaagggaaagtttcactgcttttgaatttttaaaacattttgcactatatacagtattatttatgcaacaggtaaatacaatttaaatgtcctaacaccaatatgttgtgaggtaggctgtttgatacactattggtgatattctgagttggaataatcttttttgaaagcaatttaataacatgaaacaagaatctttaagtagtttcactttttaacatagcaaatatactttctggtatctatcctcagaaaatatgcagagataaaatgtttatcatggtgttatttataactatgaaaaattagaaataacctaaatgtccaatgaaattggaacaaataaatttgatgcagtcatacaacagaataatatacagctatttaaaaccattttgaatgaatatttaacaacatgctcaaaatattgtgaatagaaaagtaaggtgcaaggtctcacacatggcatgaccctaattttccccaaaagttatgtatatacatactcacatgtttatgatgtggttcaggatatgctaccccaaaatataacaccttggcttagaggaaacagcaggaacaagacattcactcttacctctttcacctattttcacctgaggcaggacatacaaggattctgtctttcctatgaatgtcataaaaccatcattccagagatgtcctccatatatccggaggaaaggaacatccttatcctccaagacacagagacacaaagaacaatctgaatggtttcccaagtttaataccattagatcatatcctcttttgtccaatcagacctttgcacaactgacaactcttcatcaaacctaagcataacaatacagtttttactgtttctctgggtcttcatttctgaagtcccctgtgtcctgtaaaacttaaatagatttgtgtgtttttctcttgtaaatgtgtcttttgttacaaggatctcaccatgaatccatcaatgaaagagaaaaaaaaatcagttttctgctatacttctcttatatacacataaaaacataggaaagaaaccccacaacatattaagataattatctctagatgctaattcaatatcactgaatttcaatatctcctagatatgattttcagtatcatcttgaaaattactgatattttataaattttctatgttgaaaatgtattactcttgttagcttaaaggatatttagaaaaaattgaaatatttaatgctttacaacattttaaacataaagaaataccttgggtcatattgtacattctcctcccaataattctgtacattgttaacaaataaaacatcttgagttacaaaatatatcacttatgaaagtaaagacaaaaataaaattatatttactcttaccaaatcatgttatgaaaagtaggggttccagaaagagaagagttctgtggtcaaataagttaaagaaacattaagctacatttcgtagcctcctcctcttagagataatgaattaattaatattatcatattaatgcttttaacagatcctgcattaaggaaaattgtttaaccatttaacctaaagtttctctctcttcctttctccccttctctaaatatctaaatatgccccagtattccaaagaacatggttaagaagatgatgagcttgggaacttttaagacccctctgtctaatctctaattatgtctggttctatggcactggctcactgcaacctcagtgacaaccatagtgtgagggctatcctaactctctcctgatttccccaagacaagatatcatacctgatcattttattgtccatgtccaccctcccttccccagtagggtttacctgcacagtatcgcttctacctatcagcatatcagaaaacatatactaaacatatactaaaacactgtgcaactgtgtttctgatgggacaaaaattattagtgtaagagaatctctactatttccactttctttagaagacaggtcagttttttaatttcctgtgttcagttttttctctcccttgccctccaaggaagtctcttccatttattgtttgagctttaacaatgcagatttgggagaatgggaaaaagtagtggtaggcaagctgcaaggaaaaatactggaagagaactagaaggggaaacagttgagagcagtagaagaaagtggagttttaagaattgttgctgtggatcatgtattgtctttgtagtgtttaaaaaataatgcagaaagaaatgtggaagaacgtgtcacaggacttttccttagttcagctaaagacggggtccttgtccatcccatggccacaaaaatttaggctcgcggacagtttgaaggtgagtgaacagggttttattgggtgaaaaggaagaaagtggggaaacagggactctcgctagaccagagtccctgctagagcacttccacccagcagttcttcaaatcccaggtttcacacaggaaggggaggatccaggctccttcctgctgcaaacgtcgtgaacttccctaagctccaccctcactgggcaggctggttggactttctccagggacgccctcccacctggctgtgtcattctctcctctaaagaaatacatctagctgctgttagattcaggataaggacaaagacccatcttaactgcttcctgctgaaagggggcactgctgttttggggaaatgacagagctccctcagaggcctatttaagggtccccagc

SEQ ID NO: 1260 - DNA, 3018 bp, Homo sapiens
gctactcgggaggctgaggcaggagaatggcgtgaacccaggaggcagagcttgcagtgagccgagatcgtgccactgcactccagcctgggtgacagagtgagactctttcaaaaaaaaaaaaaaatgatttcttgtattattatcaaaagctctccagattgagggtaacatcccaaatatgcagggaataccttaaggacaaaattgtaagtttgatactttgtaagtttgatacttcagtgctgccactttatgaaactttctaagttactattgttactagctaactgatatttaaggcactaacatttttaccaatatttcataatactagcactgaagagaagtttttattctgttatgaagatgttaattaaagcaattatcaaaatggtcccataaacattgagaccatattctgaaaatataattaccctttattgtttttctcttccttgaaaaaaaaaagcccaaattcacaaaaaactttagtttcataaaactcatttgaagtacattcagtagttttttaaaagatattagtttcagtggctctggaaaatattccaagaatctaagctttttcctacattcttctacttacgtgagattaagtctatgatagagttcaagtgtcctggctttaaatatttaacaggaacaagagtagaggtgttggaatatttaccagggtattagtaagaggaaggagtggtttgtcagcacatggttatttgaattctagctataaatccaaacccagataagaagacaccaaaagttcatttcatcagctaccaagatacactgaaaaatttaaagtggtcataaattgtattagctcctcccatcaagagatagattatttccccaccatgtgaatctaagttggatgactcatgactgcttggactgatagaataagtcagaagtgatgttatgtgacttttgagcttgagcttcaagaagcttgcaattttgctcttgccttctggacttgaggccttcgtgtaagaaaagtgagagaggccactgcagggagagaccaggcggaacacactctgaaggccccaacaaacctgtcttagtccatttgtgctgctatcacagaatacccagactgagtatcaagaacagaagtgtctcagttctggaggctgggaagacaaagatcaaggggccagcatctgatgagggctgctcactgcttccaagatggtgctttggatagtgcatccccagagaggagaaatgctgtgtcctcccttagcagaaggacaaagagcaagtctactcccacaagctcttcctataacagcattaattcatcagggctcagccaaacacatcccaaaagccccacctcccagcactgttgcactgggggttaagtttctaacacatgaattttgggggacacattcagaccataggacaacctcctgataacagttaattatttgaatatacccccggaaacagcagcaacataactgcctaattgagccctgctcaacttcgtgaacaaattgccaatttaagccactacatttgggagaggtttgttatacagcaagagataactgagaccgagcccatttcattggctaccaaacacaccaagtcagtaagggaaatgtactagcatagttggggttttactatcaggtctccaccttcaaatttctacagcactgctctgcctagtttggtcacaatttatttccaatcaagacaactgtagttgactcctggttatctgttcctgcccctatttacttcccacatcaatctaacgtccacgttattcaagtggctaggatcctaattaacattctccctgccgtcactcttccgctcaagccgtggataaaaccctgtccgtgggataaaaccctgggcccagtattcataaccttcataatgaggctttgcctgacttacgagaggtagaggagtatttaaccattgacccccagaccccacagatcaagggttattcccctgacctctgggcatgtgccatggcctagaaagttccttacagcaccaaaaatctaatttctttatattttctttagattaataaattaatctaatacctgagatattagatgaagcacttgaagtgagacaatctcagctaaaaataagtggaagcctgcagagaattgtccagtatagtcacagctgaaatcagagggccagtcaagcatttgtgaatccatgtgccagctgtacctgctgctccctgtctgaggtcataacatcaatatccatttccttaggaagccacagaaagtctgatgtaaaaggtctcctaggaagtgcacagatatcctggacctcctaagctgtttatgcaaaccctgaacctccataaatcatcttttcaaacaatgttatctcagttaaatttatccgtggactgtgtcttcccaggaaaaacttacaagacaatcagaaacatctcctctagaaccacctgatataggattattttgtaagagaacaacccaaggagcctctataaccccaagtgatcaaaacttaaatcaataagaaattgacatcgtgtgcttcttgatctgatgcactgagaacaacacaaagattatcattgtggcgatcttaccaaagatacaaaacctgaatttaatcagaaagaagcatcagaaaacccaaactgaggaatattcttaaaacaaacaaacaaacaaacaaaactgtcccgtactcctcaaatttattgacgggggaaaaaaaaaaagaccaaggaactgtttgattggagagactaaggaaacatgcttataaaatacaacatggcccctgggttggactgcagcctagaaagacagctgaaaattttgaataaggcctgtgtatgaagtagtattgtgtcagtgttagttttctaattttgattaattgcattatagttcgatctggatgaaatgatgaagtagctcttgtaagagttcaaaatgagaagttaaaaagtttaagttgtta

SEQ ID NO: 1261 - DNA, 1929 bp, Homo sapiens
aaacaagcatgcaatgtgaaataaccacatcatggacaatggggtatccatcccctcaagcatttatcttttgtgttataaacaacccacttatacttttgcaactgtatattatttaatgctttttgttttttaagtaaatggaagtcggaaactttaattttcaaaaattaatgaatgtgacatggatggtagaaaatataaaaccacaagtttacaaaattttctccatttacctgttttagaaagaaatagggcaagtgttgagcctgagttatcatttgaacaggtaaaagagttattttttataatgcattacaatttattctggttcaaagaaggtatgtttagaatttggtagaagaatgacaattatacatattctagaaaaggagagctgctgaactgaacacataaaaagcgaggtctctgtcctcttaaacacttttgtgctgagctgcattttaggggctttctaaccctgcaggtaggattagaagttcaagcctattttttaaaagttattgtattctctaaaactgtggaggaaaatcttgacaccatccatccaacaatgaggtgtgataaatagaaaaaaaaaaaacaggtggaaaaatttacacttgttaaaaacagttttcagaattatgcttgggttttcaaaactgaagtcaaagtatgtgtcatatgcgttaatagtgccttgtggagtagaatctgaataaagcagaactgacttgcatctaggtctaggactgcattaaagtaagattctagcagaggaagcagttacatttgggtctgaccccaggaaagcatattcattcatttcttggttcactggtgagagcaccatgaaagcatctggaggccttctgctggtggagctgccagcaggtaccctgaccccattgccactgttgtttccatccaaacacttggcatgtggaagaggccttggaaggaaacgagagtcaggtcctgtaaggtgtaagcatacaatgagggtatctcatatctaagaggaatgaatggttcctctcagttaatctaagcagcgctgggcagtatgctcattcctggtttacagaatcatggtgctgagactcaaggttgcaatcttcctgctcagtgcatcttacctaaaattaacttcacaaccccatcacagctatcttaagagactgaaaagaagccttcttgagcactttgagctatttaatcacattgtaacttttttaaaaaatggcatcacaacactgtttctcatgtggcttaagaagcaataaaaacattgaaagctccactatggccatcatagcatttactgattaaatcttaactttttagagaatctattagttattctaggtcaggagtcagcaaaccttttctgtaaagggccagatagtaaatattttaggcttggcagaccaaacagtctgtcacaactactcaactctgccatggtagcatgaaaatagctgcaaacattaaacaagtatggctatattttaataaaacttaaattttggatattaaaattcaaatttcatgtaattctttgttttagttttgtaaaaaaaaaataagaatgcaaaaaccactcttctagtttgaaaaagcagatataatccctgccctacaggagttgaccatctaaaacaataaatattgataaagacatataaataaaatacagagaaataactatacaccagacacaataagataacagtttaggataagccattcatattagatgtttgacatctctataagttttactgatgactatcttaggtcatttaaagccactagttaatttacatgaagaagggaaatcatcagagctttccagcagaaaaatccaagtggttattggcttttattctaactctatgactatcttgggacagttctctgaca

SEQ ID NO: 1262 - DNA, 1921 bp, Homo sapiens
tttaaaccactgttatttaggttcaggagtgtcagtcacctaccgttaaactaaatccctgctaagaaagctacctttttcttaacccacaaagtggaaaaattcttttaaaaattatagtatccaaaaatgacagtggtcctctgactaggcattcctacacatcacttgtggcacatcttttctgaaagaatttctgctagtatgtaacagaagacttacagtatacaagccattttacccagaaattctacttctaaaaatgcatcctatgaaaataattaaggtgtgtgcaaaattaatatacattgttgttcataaaatcagtatttataactataaattagagaagctaaatgttcaataataaaggactagttacaataattatagtacttttatagaattgaacaccatgcagccattaaaaatcagtttttaaaagaataattgatgatatgggaatataattaagtattattaagctaatagtaaagatttttaaatagtattttattatattcagtttgggaggctgggtaattttaaaaatttattctttgtattttgcagtatttttaagtgttctataataaatatgtataactcctatttttttttaatgctcattttaaatgagcctatgtctcctgtcttccatcacataactgtcttctccagttaggtggtttcttctgtccaactgcaggcacagggtgttctggtccagcatgccttgttggctggtaccatgggacaatttttctgctcccttttctgtctttccaaggcatgaggaacacatgatttataaccataggtcaaatattccctctccaggacattctaagccctttagctaattctaggaactacatgctcctgagacaagaagcatgacctctgagccacactgtgatgtcccttagctgctgctcagggacaaggaggcaacaaaccaaggtgcacagggcgccagagggcaaagtagtcagttgtggttatcacagaaagccaataaggaaagccacccagagagtgtagaggccaacttgcatcagaagtcttggagtaaaccagagatggctcctgaggccatctctggtctcctcctcccctagataccaagttgccattgttcctggcaccttgacaacttctgaccttgcaccaatattgcctgtaaaaaggatgtgctctatctccattagaaaatgtgtttagctgcaaataagaaagcttagttaacagtggcataaattcatggggatttactttgtgacacaagaaatcagaagaaaggcagtcacaatgttgcttcagctactccatagtgccactggggacccaggttctttctgggcttcggctcagtcatccttaatgggtggggggtgggtctgaagctttaggcttggcatcttgtggctacaaaagggctgctgcagctccactcacacctctgcaaggataaaacacagcacaagctctgcctgtccctgtttgttataaaagcaaaagctttcttagaaatctctagaagactttacttgcatttcacgggccagaactgaatcacagggccacatcctcagctggaagagactgggaaaataagaatgcaggtgagcttattcttcctcaaagaaaaccagaatcaaatggctatgggctagacaactaacagtgtctctgctacatgtctacaagactaattctagaattccaaggtcttttggaaggctggtattgtcaaattgtacaaagagcagatccatgtctgtgtgtatgtgtgtgtgcatgcgcatgcacacacattaaaaaaggaaggaaaatggtatacattgagcaccttttagaaccagccactttcataattatctcaattaatttgtttcattctaataacctcacaagatag

SEQ ID NO: 1263 - DNA, 2137 bp, Homo sapiens
ttagattctgaggcttttgttctgttactaagcttgacaacttctataaataatatatacatttttatgtatcaaagactttatgataaaatataaaacaatgtttataggctcctatggaggtgacaacgaagctagaaccacacctcccagaaaactccatgagcaagtgcgggtagagccctccaggaagggttgagagtgtgaagctctgctcctgagcccacggcctcccacagatgttctcttcccacaacacttctctaattctcacccttgaagttaccctcccaatcactttccctcatcctccctcctcccttctcccaggttctttctagggaagaacagatacagaagccaaaacctgatcaccattccagctttacactaaggactctatgtaaagactataaatctctgttgttgaagcacccagttagtggcgctttgttacagtagcactaacaaattaatattctttccatccagattttttaaaaagagagagactctaaggaatgaagacactttgtcttaggtttataaagcacagatctttgtgccaagatggctcagctctgctggaaagaaacaaaacaaaaactatgaaacagcagcctcaggatatgagcagttggacctaaagaacttggccaagttgtatcagttgtgacgcatgcccagaaaagaggaaatattaaaaattcaaacctttatattgattttatgatgaagcagtcaaataaataattaactctaactctctaaaggaggagagttgagaaactaggaaataagttaaggacttttaaacattatactagaacccatactcatacacaacatattattataaatacaaacccctggggattctagaccctcgacctgctaaaacagagatgcctgcctgcccttatcactgcagacagaaaaagaagcaagagccaatgacgacatgaacaggcagatacactcaaaatgttgacctacttaaaaataaatgtgctagcagatttcccaaccaatctttccttccattttgcataacactctaatacattggttggaatgagtgaatattttccgtaaatggtcagtaaatctttctcttttatgatttgtaaagcacagctaacaacctctttctggttcattgctcacacaggtctcaaccgagtacatttctctaccacaccacactctgctttgcctctcatgctttgggtattatttttaacattttattcaaattgctttctccactgtatttcatcaacctatcatccattttttaagccagactgttgacagttcacagttgacaattttgttcacagttgatgaattctgatttgtttttattcacccaaaatcatgtcacagtaggtggaggggagcaatcctgaggctttgccggctttaataattgggcaggaagtgagcggctgctgactgcaccagtcagatgccaacatgctgttcctggctgacgggagaataaccacccatttctgcacagagcttgagtggctcagtgttcatctggaagaagctatgcacagaaacaagggaaggtctttggtctcatttagaaccttattgaacatccataaatacatgtgttcctttctgcatttaacacatattcactgagcatctactatgggccagaccctggtctaggtgtagaaccaatgggacaaaggcctgtttccatgaagttcacatggcaggcattgatgggagtcagggaattaagcaagagagagaaagagacagagaataaaggagagggaatgatgtatggtgtgatcagtaaatcttctggaaagatgacatctgagcagagaacagaataaagtgagtcatgcagctctctggggaaggagggtcaaggaaaaaggaagcacaaaggcccagggtagaagattttgactacacttgagaaacagtgaggaagctagagagggatgaggagagcgggaaggaccatcttagtggaaccgatggttggcctgtgtgtgacccacggcacagtcttttattctccctctctccctctgtgtggtacacacacatttctatgagttaaggcttccaaataagtcagagccttaaacttcttgaagac

SEQ ID NO: 1264 - DNA, 1714 bp, Homo sapiens
attttgacctccctttggctgtactctacttaggataaattccctgagcctcttcaagacaatctttggaaggttcttcagccacagagcctttcttacctgtctgacccattccacacacactcaaatttatcaaaaatgcagtcattttcatagagggaacacagcttgctgcggaggtagtcatgaacctggagaggaaacatatcgagaaggtcagttattattttaaacagtaattatttctgcaaacacctcctcttctgatgtgagctgttaaatctttcattgtacatgctctttgaatcagatggccttggatctgaacctaggcttggcccttttagctgtaggacattaggatgggttgatgagcttctcatgtagatgatatggattaatcaagcttgcttgtatagacagtggcatccagtaagactaaataagtggtagattctcattttctaagctgatttgctcacaggcattagagatcaccattcatgcagtcttttattcaacaaatatttactgaatacctactacgcacttgagatgcagcagtgagccaaatatccttgcagtgcttttgacccagtgtcaggtgacagattatataaccaagtaaataaataagatgtttagatggtgataaaatcatagaacaaaagtgtatggaaaaagagcctgggagatcttgtcgggggtgtattattttatacagggcaagtagtcagggcttcactggatgaggtagcactggagcagaagcctgcaggagatgaatgagccacagtgatgtctgggtttggggtgaggggaaggctctccaagcataggaaacagcaaacataaaggcctagaggcaggaatcctggagggagtgtggtgggagaggagtgagtaagcagctgggggagaggatgatcagtttacataggccctttattctgaggaagaagagacctcacagaaaggattgctgaatctgctgtgttgcaatggatcctaagggtgcaaaggcaaagggagggagaccagttataacctgagtgatagattctggcctggaccagggcatgagcagtgatggggactggtcagattctccttttgtttagggaaagagcagataggacttgggtcaactctgaggtgtggagagaaaaacaggagtcaaagatgactccctgatctttctcctgagcaagtggaaggagtaggtaccatgttcacttttgggtacaatggtttagagatgtctacatgtggagctgtcgagtagactctgaggtgaaaggtgctgtcctggagtatgtggcgattctttcctggtttctcttttccagtgaaagcagccagcatggttatcaactaagagtgagcaggagagagaaagggttgagaaacagtgtcagatttctggaaggcaccaggggacacttgacgttgttggacatgtatgtcaaataaggctcatcaagcatagttgaatatttttctccagctacattcagcaactcagctgtagatgccaaatagatgaataaggttcagagagtagtagcctgggttctctgttttgaaggtaatccttcctgaacccactagcacggagtggcaataataacgggcatacccaatatgctggcttgtcattattagccaggtgctttatctgtcaaaacctcatttcatctctaaagccatctta

SEQ ID NO: 1265 - DNA, 1145 bp, Homo sapiens
agatttttttaaaatgttattgttaggctgggtgcggtggctcatgcctttaatcccaacactttgggaggccgaggcaggtggatcacttgaggtcaggagctcgagaccagcctggccaacatggtgaaaccacatctctacgaaaaatacaaaaattagccgggcgtgatggtgagtgcctcatagtcccagctacttaggaagctgaggcaggagaattgcttcaacctgggaggcagaggttgcagtgagttgaaatcacatcactgcactccagcctgggtgacagagcgagactcttgaaaaaaaaaaaaaggtactgtttttataaccatcttaaaactagatatgacctaaataaaacagttcccaaaatgtaagttcaaaaggaaggaaaagaaagcacaaaccaagatcctttaaacactccttgtacctgaaatctctggtcctagtcagggggtgcacaactagtggcaaactgatactgctgaggtttataattaacaatatgaataataagaataaacctctgtgtgtttcttagctgtctgttgaacagggactagcaggtgggtttggctggctctcagcaaagcatcccctgaatggcaaagggctttcataaagatgtcagccttggcacacgttgtcaagtaatcttttgggtccttttattccagtcagactgtgttaaagagaaagctcatgtctgtctcatccccgagaggagggtagagaagggctggagagctgagcctgagccttgagctgaggaaagaggcttacaatcagtatgtgtcaggagaaggcctaagtctgcagctcgagggaggatgggggaaagggaacagggacttttcacactctacccactaagactcagtttctgcctcttattctggtggagctgtctctgacttccacttagtcagtttcttgatggctccaagacgactggacatagtctttctgagaatgttatattttaagggactgtcctttttgcagaatagagaggagaaaatcctagaattttgaacttacaccatttgctggaaaatgacctataccgtggcctctgtaaagtggaaactaaatttacattccagatgctgtaccaggtgcattcacatatggca

SEQ ID NO: 1266 - DNA, 1770 bp, Homo sapiens
tttaccaaaaatggggccttataatttggagactactgtttgtcccctctgagcctcagttttctcatctacaaagtggaggattttcacaatgttgcctctaaagtcctttttagctctaaagtccttttttagctctgaagtcctaaaaacctttatctgcccatcagactcatctctattgtcttccgaacagcaaagctgaacttgaaaaagtgtctccatcagggccctatgtccttagcacctccttaaagtcaatgtgtgaaattgcttttactgctgaatggggaagttggtaataaaagccaactccttgggtgccctaattccactttaggaagaatgaacatattgttttaattaatcatacaaaagcaaaattagcatgattgtgtgataggtgttgtaaatcatcccgatccacatcattgagcaaggagcatttagttattccagagttgttaaagatttttatctacccaagtgaaaattcaattagtactagcttcagcttatataaaactaaggattttcaactgtgggaaaatactctttgtgtgtgtgaataccaccttatgccactttgataaattactgtaattaactgtatcctacgcaagctaaacaaaatttactgaactgttgtagtataaaagggatatcttctcttctcttgtttggtagattactcatctatacatgatattgccttgaatatcatgctttttatgctgagatctgaaaatacctacagaattctggctgggtccggtgagacacgcttagttttcatcacttttccccttttcccctctgggtgtagggacatcagctatgggcttcactatgattcaattaaatgcgctatgtttaattagctagctggggaaacactgcaagcagaacctacttggaacattataacttagccacagggctgagttattttgggaagggcagaggatgatggaagaggcaaggagaaaaagtcaaggagacctttacttgcagctttccggcacgaactctgtgcttcagccccatgtccctccttttcttgtgtacctggctctgcctgcctctcctctctcacccaaatcttacctgtacttcaaggcctaccccttccttttttcagaagccttccaaagagacttataggtatgtttgctgggtgtgccaagtgttctcctctgatccatcaacctatctcgttatgggttctctgaccttttctcctttgtcatactccatggggtctaattctcaatgaggaaacaccacagacactggcaggattcccagtggaatggtccagcttcattctgaacttcataccaactgtgcaactctcaactcttcaagggcaaaactttgggaacaaggtcactctgagccagagcttgtctagtgtgttgtggtcattttggaaggatttttcaagtaatttttagtagcaccaacactgctaccagtgcattgaatgcatgctatgtagcaagcttgttgcaaagaaccttgtaggtattatcttctttaattctcttacaggttcctatgagatgggtgttatcatctctaatttacagatgagaaaacaggctcagggaggtaattaaacttgctcgatctcacatacgtagttagaaacgatatttgaagccatgctccatctgtcactaaaggttattcttagcctctgtgcaaaactgcttctcatgctaataattgtgaaaataccaaagtattcaaatgatttactcacct

SEQ ID NO: 1267 - DNA, 1832 bp, Homo sapiens
aagcttcctgtaagtggatccagccccaaggagaaaagattacaactctgccctttacagaaagcagctcgtaggagtcttaccttggtagtgggtgttaaggaacaaatacagatttgaactctagttctataactgaatcactagctatgtgactttgggcaagttactcaacctctctgaacccattccttcatcagtacaatggggataataataacctgccctaggtggttctcataaggattaaaagaaaaaaccattaaaaatgataacatctgccatttttagagcactggctacatgccaggttctgtgccatgaactttatacattatttcatttcttctcacaacgatactgtgaaataggtattcttaattctgcccagtttacagatgaggaaactgagactcgaggacatgaagtgacttgcccagggcacacacatagctggcaagtggcaaagtcaggatttgaaaaaaaggggaggggggcaggaatttggatacagacaaacacatgcagaagggagagatatgaagacatagggagagtgtcatctataagcaagggatgcctggggccaccagaaggtgggaaagaggcctggaacagatcttccctcacagccctcagaaggaaccacccttgctgacaccttgattttggacttccagcctccagaactgtgagacaatatgtttgagttgtttaagccacccagtttgtggtactttgttttggaagctccaggaaactaatacagctgtttcttaaaacaagtgttttggctgggcatggtggctcatgcctgtaatcccaacacttcgggaggccgaggtgggcggatcacctgaggttaggagtttgagaccagcttagccaacatgacaaaccctgtctctactaaaaatacaaaaattagctgggtgtggtggcatgcacctgtaatctcagctactcaggaggccaaggcaggagaactgcttgaacccaggtggtggaagttgcagtgagctgagatcacaccactgcactgcagcgtgggcgacagagcaagactccgtctcaaaaaaaaaagaaatgtttcactgcaatgatttagtgtttctcacttttcatcctcctctgcttctgagagagtaacagattttcacaaaccagggggcagaaatacatgacattgtgaagagggtaaaatttgttctcaacctttccataactgctttctgcacctgacaattccttctcatgcctctgacctagagcattcagcatctcatactgactgcctccccatagctaagaatgcctctgggtgccttcctcagctctgctgaagtcagtttgctataccaacttctcaaggctggagattagaatgtgtttttctatggtttaggaaaacctccttccaccaggaacttgaatcagttatgaaaattaggtagcaatcagggaaatgcagagtttaaacattagaagtcaccttagagacaacccatccaagggcttctgactgatccaaggtgtggattgaggcctgataatttttatttttaagttctcatgggacgagattctgggaccaccttctgtctttcaatccagaggtgttgtatatcaggtgagcaggcttctcaccctgttcaatgagaaagaattgactgcacctcaatacaatggttcttatccttggctgcacattggaatcacctggggagattttaaaacccaccaggagtctgatttaattgctctgaggggcaggcgtagcactgatgttttgcaagctgctgaggggattctgctgtgcaatcaggactgag

SEQ ID NO: 1268 - DNA, 3347 bp, Homo sapiens
ccgggggctcagtgggtcatgggctttgaggtctggcttctctactgtgttaccctgggaaagtgtcttgagctctctgagtctctacgtgctcatctgtgaaatgggggttaccctatctcccttggaatgttgtgaggttcagagtggacaatgaatgtgcttgcagtccagtgcacatctgggttcatactggggacccaatgcagctttctgacttaactttcggaggtggaagtcaactgttggagatcgctctcttagggacagcctttttgtgtctttctaggtatgcagaagcagtccaggcagtacaatcagccaaaactgattatgaattctggttatacagcttcccagctggggaaccttgagcaattcatccacctctctgggccccggttatgaataaaatataaaagaaaatgcaggtaaaatgccctcttcctcaagggaatgccctctttctcaaggggttgaggtcaggattaagtggcataatgcaagcccttggcacagtgcttagctcgagggatggtgacaaatagtcatgactcttctttgatggctcagtttccagctgctctccctgagatgccatgggaggttcttggctgggaagccaactgtttctttgtctaagagggagaagatgctatacatcttgctctcacttaaccctgctccctcccactcaccaccaccctttttctttttccaggccacatgagttttgcagagcagacgtagaaagcagagaatgaaaaaaagaaaaagaggagagatctgaagccagaatgggcgtcatgcaagaggctctagagttgcagacagttgcagcccagatacgacgtgcaaagagagacatcccagatctcccacacagaactccggcgcgctttgaagtgttgacaacacataaaattaaaagcatcacaatgcgaattatcacgttgttttttccactttgatagcctctacaaagcattttataccgatgaatcaatacaaatgtctctttataaagacattggaaacaaaaagatacatttttttttttccttaagagaaaccgacacaactaacaaaaagatttcagccctggcttgcaggatagctctaggtaacatagtgagtttgtctctccttttcacagtggccttggaggtcactgctgtctacttgcttgggtcaatcattcagcctccggatgaatgttctgcctgctgattagtcagcaccatgagatgagacaaacaagccacaattgcattgctattgcctcctgactgcacacacatgtgtgtgcacatgtataagaatatatacagtgtgtgtaaatatatagaggcgtgtgtgtgtgtgtgtgtgtattttgtggtttggtaaaataaagcttgcaaattaggattaatttataactcgttataattggattattggctgggactccctttatgttacagcagatggacttttgcgtgaaatattttccctgagttgctatagagatgtgccaagatctctctgctgaagtgattccccgcaggcctgtttgttgttgtgcccggtgccgaatcacttgcaggctgaatcacttacagccctcacagaggctgatgaaagagccccgggaccctgggagtctccagcctctcagctactgccaccagagatgggctgcaaaagtcattagagctagactggggggtgggtggctgagctggtgggtggagggggatgtccaggtgagccaggcagccacaggggagagggctgctgtgggcaagaaagataactcaggctaatcaaagacctactgtatggccaggcacagtggctcacacctgtaatcccagccttttgggaggccgagatgggtgaatggcttgaggccaggagtttgagaccagcctggccaacatggtgaaaccccgtttctactcaaaatacaaaaatcagctgggcgtggtggcacacacctgtaatcccagctactcgggaggctgagacaggagaatggcttgaacctgggaggtggaggctgcagcgagctgagattgcaccactgcactccagcctgggcgacagagccagattccatctcaaaaaaaaaaaaaaaaaaaaaaaaaaaaagcctactgtagctagatgtagttctaggaacatgtagacattccatttatctgtctagttcctgtagcaagcctatgaggggagtcctgtttttcccacttttcaggtggggaaaaggaggcacagaagagtgaagctgttttctcaagctaccactgcagtgatcttagcaatggtgtctccccaaaatgggggtgaggtgggatagatggggtacatttaaacatagggttctgggagaactgagaagccacaggctgggcggggtagccaaatttagccctctgccagttcctctggctgtcggaggatcctcagacaaaaccgccaaactccatcacgcaactcacagtccatttgggcagacacactcaggcctgtctgatgagcaacataaacatggccaagcgcctcatgagacgctgtgggtcctgactcttgaaccagaggctgagtatgggggccccaactccccgatttccatctcaggcaaagatgtgaatcaggcaatgtttccagagagcagagtttacaaaaagtgtggcctggagtgatgacaaaggcatgggctttgaagtcagacagacccaagttagaatcttgaatctacccttgtccagagctgtgacttttctcatctgtaaaatgggattcattgtacttacctggcagagttaggctcagctctcccagtagaatggaagctctctagaacagtgcctggcgcacagtagaccctgtgaaatacacattgaataaatgagtatgtttttagtatatctggcatgtcataggtcttactagatggtagaaattatttcaatctggcacttttagactttggagcccattttcttctttcatattgttagcttcccttcctgggcagtgtcaagatcctgagtccttgcgtctcttccccagcccctaccaacccatgtagacaggattcttggagactacaaactgcccaacgtgttaaccagtatctcagtccatggagatctcttcctaggatagcacgttagtcaggactctttagatggcaaggacagacactaactcaatctgtcttaataaatgaacaaaggaacttactaataggagtaaatggcttcaggtatggctgaatccagctgcccagctaatctctttacatttcttaaatttattctctttcagtttgaatccaccttcaggcaggctctgcc

SEQ ID NO: 1269 - DNA, 14027 bp, Homo sapiens
ctccggcctgggtgaaagagcgagactcagtctcaaaaaaaaaaaaaaaaaaaaaagaaagaaatggtgatgatgatggtgatggtgatgatagtatggtggtggtgacgatgatgctgctgctgctgctggtggtgatggtgattgtagtgatgatagtgatgataagtataatgatggtggtggtgatggtgatggtgatgataatgattgataattatggtggtaatgatggtgatgataatgatggtggtggtgatgataatgattgataatgatggtggtaatgatggtgatgataatggtggtggtggtgatggtgatgatggtgatggtcgtggtgatgataatgattgataatgatggtggtgatgatggtgatgataatgatggtggtggtgatggtgttggtaatgatgatggtgatgaggacgatggtaatgatggtggtagtgatggtggtggtgatggtgatggtgatggcaatgatgatggtgatgatgataatcacggtagtggtgatagtgatgatgatgatgatggacaaaggaagacaaagtagaaaactctcaggataaagctgttagggaaggcattctagtctcatccttcatagaggattaataaagaaacaccaactggatagagtgagaaagggcagtaccagcaaagagaacagcatgtgcaaaggtgtggaaacacgacatggttgtaatgactagctggagaagatacctaacacacccatggcttacttttactgcagaaagggaggaatgaactttaaactgagccctttctggctgaatctcactcactgagtcccttgcaaagggacagatttcgggagatttgctcccacatagcttgaagctcaccttggaccaggaaattggactagcctccagaaaatatttatgttggaatatctggagactgcacaagatttgcagatattttcataatctctttcacggtttacacagcgtgccacctgcctctatctcctgaaaaggaaaaacagatttgtaaagagaatgggttgcaatgaggaaagggaagtcacacagactatttggctggcaaaggtttgctgctaagataatgtaaattgcggccgtgctgaactgggagggtaacttctacatgtatacatggcctgctttgcagcctcctgagcacttccacatttgttatcttttatgagcctcacaaaaatcccgttaggaggggctgttttcctcatattacaaatgggataacagaagctcagagaggtgtaggacctactcaaaggcacacaactaatacatggcaaagtagtaagcagcagattcatcactgagggtgacaaaaaggcacccttgcaaaattctggctttaggccaagttcagtgattctttaggttttaaaaagttgctttgctgaaagtttgcataagctccctctccttgtacttggaaggaggactgtaatcaacctattctcttgtgccacacaaggtaagtacagggccatcaggccccacatttctcttttatgggtgcctcatgtgtacactttcttgttcctgaactccatcttccaaaccccatctgctggctggatgttatcagggaggccttgaagccacaaggtggcaggagacatgggatagatgcaacctggggtcctgtgtcaccacatggaagagaatggctggatctgcatcagactgagattttgcacatgaagaaactttgaatcattgtcccaggtcatatacacaatgggaagtgcaggcaggccttgaatctcaagcagcttggccccaaagcctgtgttcaggccactctgttaagctgctctccttcgggttatgacctgtgtcaggcatacaagaacacaaccaaatgcatcagtcatgctcccagatatctgtgggggctcagggacccctgtgaggccaagaaactttataaagatggaaaaagatctatagtgtagtatacatgacaggtgatgatcagaggggcaggaagaaaattggtgaagggctgtgaaggacattgaacgtcttgctggaagtttgtactttcatctgaaggcaaagggagaccctgagggtttctaaatagggcagaactggaagaatagtatatggggaacttcaaagaaaagagtagttagctgatggacagtctgtttagatttggagcaaggaacatgggcctgaaaatcaatgggtaattggggatcgagggttgaaaacatcttgttaatactgagagtgggggccagagctgagattaaagcagatttcaggggggtgtggtgcagtcttcgtcttgctcttcccttgaacactgcaccctctgtccgccatgtgcgtatttgatagggcacctcaaaggggaagccagaaaccctttgaagcagcaaagaagaaaagggaaatgggagggacacatgggaatttaatttctaataaaaatttttattttatgatctaaagtcctttgggggaagaaagaattaaaagccaggccattggctctctttatctttataaatattcctacaaaactttgcctcttgtgagcattagattgatccagtcccagagaaaggttttgacagacactgttaatgagctagttacggtagctgcatatcaggagtggggctcctcatggggacagcccagttgcctgtgggctcccatcatggccagcactctgtgtctgtaagaacagaggaatgagccgctgtcttattcccagatagttcaaataggcggcctttgctgatctgggtggtgtgcttccctgcacttggcaacaccatagaagcaagaaggaatcagcatcatggttgaagagggcagctagaggagagattaagacatgagggaacaagcaacagatacaagcagggagacttgtcaccaacaggcatcaaccacctgccagaaaggttgggcagagctaatgaagcaccgagtgaaatgggctttctcagaggatcaggatgggtatggtgggctagtgagagctccagaggcccattttaaagggcacggggtaggtggctatagcagccaagtaccgctgtgtgaaaaagcactcccaaatgccatggcttaatatgacagtatttattttgtcttacattcctgtaggtgggctagagatgagctaatctaggctgggcttggctggggtgactctgttccaaatgtcttttggcctcctgggactagcagattaacctgggcatgtccttctcatggcaatggcagagatgcatgaggacatgccccagtgcacaaacagacttcatggccctgattgcgtcatttctactaacaatctattggccatagtcagtaccgcatggccaagctcaatgttaaagggccttccccttgggtgaaagactgcagagtcacatggcagagagggtatgaataagggagtgatcatgaaccagagccaattcaccacagtggtctcaggtaggtcctgcaggtctagataccagatagacttctgataaaagggcaactgatatccattgttggcttttttgtttgtctttgtactgatctaccttggtcatttcaccaatccttaatgaaaatgcctgtttccttgtaatttgacaatgagcctcccctaaagtttacttttctgctttttttcaaatgtcagtgtcatttataacatatctgtgctacattggagtccactaaggatgaagaaagtcagcaccgggccctttagctgaaaggtgtagagatcagaaaagccttcatcttcacctctgcccctcatgctgcctccagtgagtgctgccctcaccaggtcctcccaagtgtgccattcattcatgtgtgtgttcattcactcacccctttgttctgcaaccattttcagagcaccttctctgttataggcactgctctagaggctgaaagatatgacagagaacaagacgcaattcctgctctcatgcaatacacattctcattgaggaagacataaaataaacaaaaataaatacacaatggtcttagattcttatatgtgctatgaataaaaaaaatagcagagaatgatgatagagtatgcatccataggcgttgacaacgtgaggctgctttggatgagggtcagggccaggctctgcaaggagatgtatgaactgaagtctgaaggaaggaaaaagagcctgctgtgagcagagcctggggaagagcatcccaggcaaaagaaccagtgagggggaaatggatctgaggcaccagtggggtcggatcatgcaggcttttatgaaccatggcaaggagcctggatattcttctaggcacactgaggtgccttctagaaggccttaagttgcatcatgacccgatttatatcttaaaaggcaatgactattgggttaaaaaatgaattgaaaggtggcttgaatgtaattcaaggagaccagctcagacactgttctagtaatccaagtgtatttcattaaaggaactccaaaatttcagtgacttaaaacaaaaatggtgatgggaggtcttctctgtgcagttatttagggcccaggctgatggaacctctgttatctccaacttcttgctttctagacaccatgatagtcaacttcccagctgtaactaactttggtggacagttaactatctctgctgaaagcttcctttctgatgaccaaatattcatattcacccttcttcctgcacagagtacgctgtcctcttttacaagaataccagatttcaatgtggtatgtagtggagtctttgccatcaggcctaggcatggctctttttgatctattggctcatggttcacaagttaatgtatcttccttctccttctacactcaatgaatatcagcagaggaggtatgggtcagacacagctgtcactggtccatagtgatgattaaatcctgctgatcagacattttgaggtcactctgctccatcagtggtggcagttccatgtttaaagtcagaatctgctggctgcagaaaattccattgtccattgttctctgtggtaccttcctttgccttctaggaggttcttccttgcccattgtcctccttggagacatctgaaacaggtgttggtaagaaagcatttcttggagaccatgcaccttttcaatctacttcctgtaggtgcactcaggagggtccaagcaagggttttagggatcaaatactcaaagtttgctttttatttgtttatttatgtattttttggtctagtctcatagtatcttcggtagtagaattccctcaacaacatagtagacttctaatccatttactttcaatcggttccatcttccagtagctatacccacaatatttttctaggtgtaattctctattctaatttatttcattgtttcttcaccttccttcttccctctttcaacttaatagcagctactgaggtcttcaagcttgggtagtgtattagtcagctaagactgccataacacactgggtgacttgaatgaccaggaaaaataatgtattttcaaacagttctagagcctggatctctaagatcaaggtgttcacaagatgagtttcttctgaggtttctctccttggcttgttgatggccacctactccatgtggtttgtcctcacatggcctttcttctgtgtgtgcagggccctcgcatccctttctcttcttctgaggacaccagtcctactggattagggtcatagcttatgaccttaattaatcttaattacctctttaaataaccttatcttcctatacagtcatcatgggagttagggcttctatatgtaaatttttggggacgcaactaagttcataacaggtggagagactacatccttaattttgtctctgccctcagtttgcctataaagaaggaagtggacgaagatcattgatttccaactttttaacatagacctcttttataggagacagatgatgcaatcacagacataaaaggatgactagggagtacagtgccaaggaagtcaagagaagcaacaattttcagagggagatggggcccacagagtaaaatgctcccaagctctccttggggtcttgttgggagacagacctggcttaggatggaaggtggatgtcagggcaccactgagtgagatgagctgaggaccaagccttgtggctcttgagtctctgggagtgttttcttgcaagtgctgtggggtccctggtgctgaggagttgattttaggcggtatgctcggagggctgatgagagtcagtgtagcctggctaggtttatgtcatgacctgaggtctcatttcaaatacagcctctagagaaccggagataaggggaagattctttttagcatgtctctgatccaacagtgtgaagacaggcttcaggaatagagatggggcatccaggacctaatattttatagtattttcttttccaattacctttgatggcagttgtggcagaaacggctaactgaccacttgaaatctgtgcttccccttcacggtgtagggttattgctgggaagtgactgcccagccattgactacacgttcctgctctcttgaatctggagaggagcatattgctagttctgatcacagtggtatatgagtagacatgaagtatgtcattgttcagccaaagaggcaaagtttctaatgtgctttcatcacaaactctctttcccattggtgaaaaccttagattccaagtgctgagatggtagtttcacaagaagaagaggaaaatacttagaggggaaatacctaaccagaactatctgttttggacttgaattttaaaaagtttttaaaaataaaataaataagaacctttattgagtgtagccaccaggtttggggattatttgttataacagctaatattgcttaccctgacaaatataagaagtgatgccgcttttccattttggtaattgtataagttttcttcaaaataagtttatttaaataagaaaatgagtacatttagagaacaatgttaaatcaacaatagtacaagtgtacacaaataagaaaaaaaatttttctcaaatgacccaatttgggaagcactggcctgtagcaagcatagatgtcctcatgtcacctttgaagaaatggaagagaattctagactagagaatttcaagagggaaagagtaatcaatgtgtgcaatgccttcaagtgttttttggggttctgtagggaaaatgccaatggtgctagatcagggggctgttacagcataatgggcaaaattaatcttaggatgaagcaatgtgatcccacggcttaccaaagtcatatttcaataatccatggggaagatgtgatccccaaaagtgtttctttgtgcctgcacaatgatttttttttaatgagcaattattcactaatctggagattttacattaagctcagaattcctagtttctcttgaaaaatcaaaatatctagccaacactggaccagcatttcctgcagcgtctacaccccgcacatacacccagcaggcttcagctggagcttagtagtgaagtctcctccagacagagcatttctccacagtccccaccactccttattgtctgtcttcctgaccctgaggccaagtggctaagtgacagtaagcacgcatcacttacactgatgctttgctttgggaagaggactatttctctgttcctatgccgctatcaaaagagaaaaacaaactgttaagcaaaagggccatgtgtttcaagaaaaattagagagaactttttttggcagaagttaaaaatattcttatgggtttaatatgtaaatacagagaatctgtattgaaagaaaacaactgaaaacaccatgaaaacaagaaatagttaaaactataaccagtctatggcgaaggtgtgtgatgaagcgcttaatgaactgaaaagtaaaatcactgcaaggtttgctttagagtgctaataaaataggcaataatacagtgaaagtaaacagatatatttgatcggcatcactcatttcggtaaagtacacagtcctcttagacttttgagtttgtggccattggccattagcaagcacagtagaccttcggaagctctagggaaatggaatacattcagagaacagggcgaagagttgaggactataatgatattgccccatgaggtattattcctgccttcttcccacatccttccttcgcttgcctcctttccactcctcctctcattcctagtgtcccccatcaactccaggaggctgaaagccccctgttatccctcactccagctttgtgctgcttctgatgctcagaatgggcaaagccatctcctttctgttgcctatggccagcacagcagttagggctgctgagccctgatcaaaggtacagccctccagggaccatgtgtacaaagacaaaagaggaaatccctcctggatgttcccctagctaaatgtggagatgtagaagacataggcttataagaagggaagaaattttaaatgaaataaagagaaattaaaagaggagggcaggaagaaatatgaatgcagtgtaagccttatctaatcatgacaccaagtgcccaaacaggccaagatccctgaagatgcctaatgtgaatcataaacattatttatctaatatataagataaaataatgggaagatctgtatgtagggtcaaagcagactcaacttcaaatcctggtgccactgtctactcaccatccaccttttctgcaagttgctccctgtctatgagtgtaagttttctcacctgtaacatggatgtaaaattccttaccctataaattgttgagtcgtaatgagatcacatgcacagggcctggcacagcaaaatgtgataacagcaaaatgtaggaaaaccacactacatgagaaacattaaacctctactcaacagctgtatttgcttgtctggcatggacctcataaattttcgttgcagtactgtggaaataacaaagtatttagaacctgactgatctgaatctgtcattcttaagagcccaggttctggataataagaaaagctacgttttcccaggcatcttgctatcagcatgagattttgcaaagcacttaatagacatcatctaatttaaacactcatgcaattggcattattattcctgttttacacatgaagaaacttaggctagcaaaggttatataacttgctcaagatccaatgccctttgctctaaaccactgctacagctccctcttgaagcctggcccttcagggagtttagccctttcctgaactcctgccccactgtcccaccaaccctgtcccatctctcttctccctaacaggcccccagcctcactagattgtcatgcatctgtcactatgatcccagtctcttactgggcctccaggacccatctgaattgctatccaccccccatcttcagggtgtttcctgtctggagtttgcttctctctctccctgcagatgagcttatcatggggctcccaatgcctggcacagagccttatatctaatcagtgcccagtacacccaagtcttcttttcctccgaccctgctaccttaacatgggggaatgttcttcattcttatctcaaaaggtatgcctttagcaaaggactcaaacagacatctctccaaagaagatatacaaatgaccaaaaagcatgagaaaatatgcccaccatcactaatcattagagaaatgcaaatcaaaacctcagtgagataccacctcacacccattaatatagctactatcaaagaagcagacaataacaggtgttggctgggatgtggagaaatgggaaccttcatgcattgctgctgggaatgtagactggtgcaactgtggtggaaaacaattcggtagttcctcaaacaactaaaaaatagaatgaacataagatccagaaatccacttctggatacaagtcaaaagggagtgaaaacaaggtcttgaagagatatttgtgtatccatgttcattgaaacattattcacagtagctaaaagatgaaagcaacacaagtgtccatcaacagatgaacagataagcaaaatttgacacatacatatggaatgtctatgaatactattcacatgaataatacgtatgaaggtggcatacatatgaatattattcagccttgaaaaggaagggaattatgacacaggagacaacatgaatgagccttgaggacatttgctaagtgaaataagccagtcgcaaaaggacaaatactatgtttccacttatgggcagtacctaaagtcgttaaaaaccatacagacagaaagctagaagggaggttaccaggggaggaggggatggggagttagtgtttaataagtacatggtgtccgttttgcaagattgaaagagttctggagatggatggtggtgatggttgcacaacaatgtgaactatgcacttcaaatggttacaatagtgaattttatggtacatgtatttttttttttgagatggcgtcttgctctgttgcccaggctggagtgcaacggcgtgatctcggctcactgcaacctccgcctcccgggttcaagcgattctcctgcctcagcctcctgagtagctgggattacaggcgtgcgccaccacacctggctaatttttttgttttttttaaatagagacagagtttcaccatattggtcatgctggtctcgaactcccaacctcatgatccacctgccttagcctcccaagtgctgggattacaggcatgagccaccgcgcctggccttttacgtgtattttaccacgctaaaaaaaacaatgggggaatagtatgtctttgggacctacaagcctttactatttgttctcttttcagagctttagcttatttagcacacaatttcgacaattaaaggttacatttaatctatcttgtatgcaaagtcttgcatcccctgaagcctgaggaaggaaaaaatgccatcctatgatcatttcattatataacacttcatgcaacacccgggaggaaatgtctccaggaaaaagataaaaatacttctgagattaaaaaaaaaaaaaaaaaaaaaaaaaacctctgctgctgcttcctttttctccattacttcaaatccagacaggcaaaagtgagtaattaaaaaaaaaattctggtgttatttaaagtgaatttggataacgaccaagcagttcgaacattaatagcatggcatgcacgtcagcgtgttggactctgtcacccaattgcctactatcccaaatgacttccccacacagtctagactttgtgtttaggcgtgtgaaggttgttttcagttttctctgtgtgtttcttttcttttttttgccaaaaagattaaaaaccagctggactcagaaactgtctttcaccttccttctctactgtgcaaatagccacagatgacacacaaagtcaggcaaagcggatttggggaacttcagagagggtcccataggtgtgcatatggacacacacacatgtaggtagacgggtagctacatgtgatgacagataaacagagagaaagactgaaaaatgagagatcgacacaccaagaaataaagctacattctagcattaagataagcttcagagcctgaatacccttggaaggtgtaaatgcttcctggcttggcttttgcatggctccctctaatatgctttcatcacaggcttttatgttgacggatccaaaatggctgaaaaaggcccacttttgtagaacgcgctctaggcagacaatggctatctttgcttcttctgaggggtgtgcgtgcaccaactaagtgacacttactggaatagagtcagaaggttagaagtatgaatgaaacacaattccaccatcaagaagataacacctactggaatagaagacaggcacatcaacaggctactgtatttcaggagttgctaacccacctcccacagggactgggcaggttggtgtgagtggccaaaaggtacccagtggggccacctgcacatcagagtccatgagcctctctggaaaggcagccagaagctcagcgctgcccgactgttgccatgcaataaaatagtccagggtgcctggatcttccaatttgtaaagaacaacccaaatgtggtttggtgcctgtataaaatttcagaatactgctattttgccaattaatttaaaaagttatttttagaattgggatcttgttctgttgcccatgctggaatgcagtggttcaatcatagctcactacagccttgaactcctgggctcaagcaattctccaggcctcagccccctgagtagctcagactacatgagcaccccaccatgcccagctaattttttaattttttgcagagacaaggtcttgctttgttgctcaggctggtctcgaatttctggcctcaagccaccctcctgccttggcctcccaaagtgctgagattataggtgtgagtcaccataccaggctgccaggcccattaaaaaaaatcagtgtgtgcaggcaaaatgtaacacaaaggaggactgggttcaaccagtgatgccagtagtaatctttgatatcacaaagtattagaaacaatataagagtatagaggagagagagagagacagagacagagacagagaataattccacaaggttggggaggggttagggagaagaattgcacgtgtgcagttttttaccaagcataaaagtaatggggaaggcatttctggcaataggaagagcacatagcaaagcacagtggagtgtgcacaggatgtggctgtcacaggacagggcctgtacccttccagccattgcaatgcattcctttctgtcttccacccaatacacaggttttctgtcgtttgtaagccactgatgctcatgagcgctctacatgagacaccatacgggcagactgggaagaattgaggttagaccttctgtgaagtctcagagccttggtgcaaatctagggagagacctctggggcaggagggtggcaggacggatgcaggggagaaggcattcccgggcttttctctggctgcagcccggacagggacagacagatatgtctacttatcaaaggtggatctcatctgccctaccactggctgccgggaccacaaatatccagacatctgggaagaagtcaggggcacagaagggcagcatggagagggtgtgtgttttcaggaagcatctaccacatgtggccaagtggaatcccctccccacttcacctggtcacatgtgaaaggcaggctgggtcccagggaatgatacatctgtttttgcagtgagagttacggaaaccctgtatttaaaaggtgtcgctgcgtggatgtatctgtaactcatctgtggaccagttacaatttgcttggccccctggcagttactgagatgagccccatagaacttagtggtaggatcccatcttgaagactaactgccctgtagaactgtgtcccttccaaagtaagccaagaaaatgaaccacactttttcccccatttttccctaatgcacagttttcctcatttcatcccatcattcaacgttcatcaagagccgggcactgggccctgtcctgaaaatacagatgtaaataaaatatgaccccttccttcaaagatacccattccacttggtctgcttgctgcatgtaagcaggactttagagatttgactttgttgagaaattaatgactggaacgggctttcagtctcctctctcatcttgtaggtgtgtggagcacccaaaaatctcaacgccagaacgcagagaaatgggaaccctcgtgcacggcaggtgagaatgtgaaatggtgcagccactgtggcaaacaggatggcagttccgcaagtaattaaaaatagaagtaccaggatctaattaaactaaaaagcttctgcacagcaaaagaaactaccatcagag

SEQ ID NO: 1270 - DNA, 2071 bp, Homo sapiens
aagcttctaataaatgaaggcactgaccaaacatagcaatgacgaaaacaaccaccaccaggatgacttattcacccagaggaagaagtgagtgagggacaggagaagatagaggaccattcacaatgctgatgatttcagccatctgcattgctggtctccacaatgatgtggaagtcaaatagggaaacttgaactgtaatgcgagtgctttgtagaagggaacttcgtcacagctgccatcgacagactcctgcctatgtggcagacgtcaagcaggcactttacccaccaagcctcatttaactcccagaaaaactcctttgcaaatgaaagtgttttcactaccattttgctcctaaaaagagtgggacttagggatgctaaagatttgctcagggttatacaacaagtgatgtctgtctgccaccaaagtccatgtgtcaaaccactgcaatattcctggaaatattcacttttaaatgctctggctaactatctaatcgctatttttttaaaagaacattttattatgttaaccaaacctctactctgcaattaactctaattacacaagcaattaaattgggagtaagattattttgcagtttgaagctatttatgctgacattagattttcctctaattaattctatttctttgttctaattgttatttaattaacagactttctaattctacctacatgttttttaagtaccagtttatccctgtgctcacacatctgggcccaccacatctgctttgatggaatttcccagaggagagaaagagaaagaagaattggtcaatttctgttgagctagttggaagcaaagcttggcctgattaatttgttgttggaaggtagggaggaaataatttcaatactttgttaatataatctatagtacagtaatcactctatctgattaatgacctagtataaaatccagggtgatcaacagtgtcactcaagatcctagaacttctttagtgttagagtgtatctgcctggggggacgatctgaagacctacaggctgcattaatttgtttgtggctgaaatcatttcaatttaatatgaatctgtctgatgataaatggctttatcatcagcggttgactcataccaatcagaagctctaactggatgttgatgaagtcatagaaccaggtactgattaaagagctaacgtttagatggtcataggctatgaatagagaacactgtaataaaggttcctggggtgtaataagtttgggaatcactgacttaatcataggtcaacatttttcagaaatggacttcacaaatgtcatctcattcagctctttattttatctctttaaacttttgtgtaactcccctaagacttatcccatctatatctacgaccagggccttttcgccctccctcataaatccctctttaggcccaactacagttgccagatattgcaaatattgcatggagaatacttatactaaacattgttttatatcaaaaatttaagtttaactatagagcctgtatttttactgggtaaatatggctaatggttttggaattctactctgttgaaaaggttgtcccttcccaaagcacctttacaggtgaccttgttgttatttattattatcattattattattattatttttgagacagagtttcactcttgttgcccaggctggagtgcaatggcaccatctcagctcactgcaatctctgcctcctgggggttcaagcaattttcctacctcagcctctcgagtagctgggattacaggcataaaccaccacaccaggcgaattttgtatttttagttaagactcgggtttctccatgttggttaggttggtcttgaactcccgacctcaggtgatccacctgccttggcctcccaaagtgttgggattacaggcacgagccaccgagcccagccgaccttgttgttatgttttcaggaattataattaagaatgtatgaagcactttaaacagaggttttcaagcattccaaatataaggactcctttattatatgtaaattctatagactctt

SEQ ID NO: 1271 - DNA, 2614 bp, Homo sapiens
taaatggctctgaatagttctgggcatacagtaagttctgtgtaagtgtgagctaccataattaactaaataataatctctaaaataaccccaatgattttgattattcccatgctgcagataaggaggctggagaggtgatgttttgcctaaagtcacacacctggcaagaggcagggcaaggcgtgcctgaccttgaaagcccacgttttccctccttaggcccagcatctacatcattgcatcggaaatagctgtttctgagaagctgtccggagaagggataaaagcacagggtctcgaggctaaatgtggggttaggatgtgattctgtcacttactagtgacttactttcggtctgctgacttctcttgccacaatgtcatcatttgtaaaaaggggattataatatgatttgtctggaagagttgcaagggaaagagttgatacatggatgttacttaaaaccgttttggcacagagaaaacagtccgcgttagccatcacaggtcctcattttatttgaaaccctgacaacagggccgggctcggtggctcacgcctgtaatcccggcactttgggaggccgaggcgggcggatcacaaggtcaggagatcgagaccatcctggctaacacggtgaaaccccgtctctactgaaaatacatacaaaattagccgagcgtggtggtgggcgcctgtagtcccagctgctcgggaagctgaggcaggagaatggcgtgaacctgggaggtggagcttgcagtgagccgagatagggccgttgcactccagcctgggtgacagagcgagactccgtctcaaaaaaaaaaaaaaaaaaaaaaaaaaccctgacaacagatgtgttacaggatgtttagatattaagtatgtaataaattgtacctggcatataataaggaatagtatcggagagttctggaccatgccctgtaataaaacacgacaaagcatatacagcaaaacccacgaataagcaccttgcctcactgacgttcaggttttgccactaaaggaaggggtcagtaggcctttctggaaagggccagataggaaatattttaggcttgcagccatacagtctctctcatgtggtcatggttgttgacccgtggcttatcctgttacacaaccactttccatgtccagagctttgaggatctgggaattccatgcaaacaactgtgggcctgtattctcatttgtatctcgtcatttcctgcaatcaaaagctctgatagctaccctcatgatctatgattagcaggaacccagaagacaaatgtatttttcagcactacccatggtttgtttggtaaagcaaaatcttttccaaaaacatggtttcgaaaagagaaggcattattaatgggggcgcagggagttcccatgccctcacagagctgagaaatgtggggactgatggccagatcgcaaggaaatgtacaatttccatcacatcttcaaaaatatgaaaaactgccacggacttttgtggcagcctcccaaaggttctaggggtctcagctactgtgctagtgatttatattttaggcaaaatcaattgatataccagcagtgtcctgctaccccagaaaaacatcatttgcaatgcatttgtaatatattctgagatatgcacagtgtaattgtcaatatcttgtgttcatgtagctattttattgccagagaagattgaggactgatacttgtaaagctccataagattcacagacgatgaacattacatcctacaatactacactacaccacactacatccaggtggaaacgagcatttaaaacaggagaggaaacaggactgaattcagccctaggaacaaaggagctgcttctttgaaaaaaaataagccatatgtccatatgtgcatgcacgtttttgacctgtcagaggtgcagagtgctgtctgcagaggctgttattcaagggaagagtcctgttagtcagacaaacatgaacttgaactcagccctacccctacaaactgtgtgaccttggacctcagtttccacatctgtgtaacagggaaatactgcttctcatcaagttgctgtgggcttatatgaccaatagctgtggaagtgtggaagctcttatcataagtccctcattcattttatttcatttcaacaaatatacattcagcacctgctgcaggacagctgctcagaccacctggggatttgcagatgaataggacagaaaaggcccccgattttatgaagcttacagtgcactggaggaggaggcatgaaacacacacacaaataaaaacgtcaccccaaattgtcagaagtggaatgaggtttaaaacactaagataaagagagaaagtgagtatggcagtgggtggagctgatttagacagggtgctgggcagccacactagggaagcagcagctcagacttgcagagtaaacagaaactgaacagaaaagaggtactgatgaagagttccccggccaaggaagggcaagtgcctagatcgtgaggcagtgtagttaaacaatggtcagccattgttctggaagtcataagatgtgtaagctccccaatcactcttgtggatta

SEQ ID NO: 1272 - DNA, 1704 bp, Homo sapiens
ctggccgcgggaccctggctctgagctgcccgccgggtccctcctcctgcgtgcgatcggtcacctgccagatggggcacctactggggatgtgcctgttgctgtcgctggcctctgagtcactaaagcctaagctccttgagggccgggtggttgctgggcccgagtctgtgccccagccctggcccacgcctgccctcagtagccccactcctcccttcacggagcaatcccggcttctgctctccatgccaggatgaggcagcgaacgcggccagaggaccccggctgctgggcgctcagtgatgaaggaatgaacacgagcaccctcaggagccaggctgggcagggagggaggcgccggctgcggggacgttctcgggaggcctggggaagtgagcccaaagggccgccccggcagatgctgaccccagcaggaagtcaccgtccgcaaggagcgccccgctaggctcaggcttggcacacgacacctcgcttccacttcattttcctaccttccggatgacgaactgcgtctcagacaactgaaaggactcgcctgagtcccacagccggaaagaggtcggggtgctgccccccgcgcggggcgggcagaggaagggccgggcccgagcggccaccaggtggcgctgctgccgcgagaacagcggcccgggccggggacgcacccggcgcccagactccgcggccgcacccgggctcccggggccccagcggccccaagacagcctctgggcctcaccctaaatacatcaattatgacctgagcaaaaagttctgttccaatcgttgctctccgacatttccattgtttgctctggaaggagctgaattatctatgctcttccctccttcagtcaaggagacgtgggaggaaaccgggatggggatcagcagcctggaggccgcctccgctggaaccgcgcccgccccgccaggaggctctgcctgctgggcaaggcgcactcagccagccccgcaggccgccacgcgaccgaggctcaccaagtccactgcaggtggcaggtgaggtcacctgggcagctctaggcccggccgaaatatctcatctgctctgttcttgggcaagttaccttacttgtccccacctgcaaaatgggcacaactgcagctccgagcttggagctggggggcttccgcccatgacagttcaggcagggtgcagtcagcgcccacaaatgtcccttgtccttgtctctgccgtgctgttgatactgatggagtataacaccagtccctggggactggcctacccgctggggctggctcatgcccccaaggggatgcggcttcagcaaagcttctcaaccgtccccatcccagaggggccctcctgcctcagaccagcctcctaaacaggtgcaggataggacagcagggaggttgggttctggtgagcagaccacatttctcaacctcagcactccagatatttggggccagataattcctgttgggtgaggcgggcaccctgttcatggcaggatgttgagcacacccctgggcactccttgccagaacccagtggaaccctccccctagtcgtgacaaccaaaagtctctccagacactgccaaatgtcccccgggtggggggaggggtggcaaagtcactcttggttgggagcaactgaccctcaggggaccaggacaaggagcctga

SEQ ID NO: 1273 - DNA, 3769 bp, Homo sapiens
gatacatatgaagcgcttcctccgatgcctggcagtcactgtccagtgactttttgcttatcttactaccatttgagcattcgacattctacattgagttacattactaccatttgagattctacaaaatctgaagcctgaaatgctctaaaattgagaatcttttgagcacccacatgattctcaaaggaaatgctcactggagcattcagatttgggatttttggatttggaaagctcaaccagtaagtatcatacaaatatccccaaatcccaaaacatccaatccccaaaacacttctggtcccgagcattctggataagggatgctcagcctgtgaaactgaaggcacagtgccgtgtgtggcactcatcccgggtctcgtttttgcattaggctgctggccacacggccacattgggaaccagcgggccttctactcctgctttaaacgctcaaaacctcaggaactaatgacacaggagtgctctcagcagttgggcacgttatgtgatatgaaggttgcaggactgacattgagagaatgatgctcaggaacacacccacatatctaaactcagctgcacaggccagtaagaacttcacacttgctaggagataaaccaaggacagctttaaaagagaaaaggaaataagaaatttgagaacatcaggttttcccccggcataagtccaaggttaggatgtactgatggggcagtgagcagccccactggacccctacacgtacctccagccaggcccgagacgcttacttacccagtggcaatgcaaccgcaatcctaacccttccttcctataggagtcctgggttcgtttagcccataaatattcatggcacacctgctacgcgtcgcgtcaggccttcggctgggctgctgctgggggcacagaagtgtctggctctacagacgggccctgccttgcctggccttgccgctctgcaggggtgacaggcagtaataaggaaccctgcaattactcgtcgtagctgggatgaggggaagcggggagaagtgctgaagttgtaacagtgaataactgggggctgacttggtctctgaggagctgggcaaggcaagagtggggagctgagaggacagggagtgtgcaccgggagggacctgtggagagggagacggtggtgtgtcctgggagccaaacgaaggccagggtgtgaggtggtgggaggcagagatcagagcctctgcagtggcctggaggacctggggtctacccgaaaggcactgggaggcactggagaggcttgaagccggtggtgatgtgatcagatcatgtgtgacctggtggcagggaggatggaacaaagctgggagcccagccagccggccagggcgcgagagggtgacagacacgaggctcggagcaggtgttggctgtgggattagatggggtgatgggaggaagattccatgcagaaaactgagcctgggcagaggaagctggaagtgggagatgtagcaactgaaagacacgctgccttcccccacactcagcagccctgccaatcgtgctgccatcaacacatctgacagctgggggtggaagagagcagagtccactgtgaagggctgcggggcagagccaccacctgaggaccgctccccaaggaggtgaagcctctatcctctttgttaagtcacatgtcaccaactgcctctcacccagcctcctgcctgggactctggaaaggaaataagcaccagcaaaactcataagcaaagaaataaatttttaaaaaggatctaataccactttccaaatataggagggaaatgaatcagtgtaattaggatttgagaaaacaagctattcccagacaatattttaacgtgaaagaagcagagtgtgatgacttaattagggaaatgccacaaacaaattgtactgtaagcctaagagcattaacctgctaacgagtgaggtctggggaaatctgggaaagccatctggaccgtccaaaacgagcaagcatggccccgctggagaaacctggattgagtactcactactcagcgcagggaagtttgtatctatccagagctctccctcatgttagagcagcgtggcaaagccacccctgctggactttgcacccctgctggacaagtcctcgctcaacttcttagcagctgtgtgacctctggaagctgcttagcctctctgtgctcccgtttcctcatcggcaaacggggctaattatagtgcctctctcataggctgtcatggagaaataatacacgtgaagcacttgggggctaaatattaaatatgaattaatatttgcaaatcacttagaaaaggagctgaaatgtgagtgccatgtgagtgtcatcgtgtttctcgtcactgtccctggataaaaagggaccacagatgcaccagcactcagcacccttcatgtcaaccagacctggctcatgtccttcttctgtccagcgaagcaaaagcttcaggcgtccctgggtaggccccaccccacccagcacgtggtccagcctgggtgacctgactctcacggccctgcacaagttgaggcagagggtgacatcctggctgagctacggcagcaccaaggagcttctagtgacctagtgtccccgatcttctgaactgggagtctaacgagaggcctgtccaggtaccaagggcttctctgatttggggttcccgtgcatcccttcccatcgtaaatggatacctgcagggcacattctcccacctcactcaggcccctgcacctgtgcccctggagcaaagcttccgcagccactctgactgtagtccctccctgccaccctctatcccacagccctgctgtttcatccctcctgacgtatgcacgtgtaacttccctgtctgtgtgccccacctgcctgcaagttacgtgagagcaaggctttgcctgtgtcttctctgctctagaatagcgcctgaaacacagcaggcatctagtaaacacgtgttggtttactgaatgaatcatgatcacaagcatttctggtcaggggggaaaatgagcatattctctcttggacgatggcctggaggttattttcccagggaattttatagcaacaatttatcccaggtcttcagtgagggcagtgagtcagagcttgggccgagaccaccagtgatcttcaaacggaaatctgtataccacttgcatcagaatctcttctagtgcttattagaaatgcaagttctcagggcttatcccaaatctaacaggtcaggatctccaggtgccagggagaggcccaggaatctggattttaacaacctcctggtgatacgtggatccccaggttgagaacccccacctagctgtggtaacgctcctgacacgcaggaattctatggatctgaacgactatccaaaaacacttcacctttcctgtcttcagctgcccaacaaataggtcatggccaggtaaagacaatggtggctctctgaaggtcatgctcaggaaagctgaggtcacaggggccatctacaccctgagccagcgctctggcagtgtttagacctggcaggcaggtaggctatgggccagacagccagatattcccttgagcagtgtatattgggctcatggctcgcttctgcatttagacaggagatgagcagatccagagtgtgctggacttgatcatgaaagaaaccaacacctagaaaatggagagaatgtcaaggttgccacattgcccttgtgcaggcca

SEQ ID NO: 1274 - DNA, 2102 bp, Homo sapiens
gtagcctgcagggatctgaagatagtttccttcgagaacaggttgacgaggaggatcgaggaccaaagggctgtgctgtggctctgcctgaggccgggatgctattggactgtcccctctgctgcttgatagagagcacgggagtgatcacttaccctggtgcctctgaacccatacccagatttcagaatgaggggcccattaaattgtgccatactccatttctcatttcattgtgaggtagagaaacgatcatatcatcttacgatccaagcactagtcaaaaggatccctgtgtagaggagtcccaggggaacagtgtgaaactgcacttgcacacattggtctttctgccaagcagaagaataatagctgtgggaccagttataccattgccaatggtggaggaaatcgcctgccttttatttttcccctattgctttgtgtttgtcttagcaggagtcattgtggctgaaatagtgttaatatcttctgtatgcttgggaggtcccacactggaggattttattaccctctgtgagagggaagaggtggtatttaccattaactttgtagtaggaatggttttattccacttggcactctgcagcgctggactccagggtacatggttgtgtggacgcataggatatatatggcgctcttaaagagtcacagtggtggcattgccaggtttgtaaggccctagatagggatgaagtgtaggtcatgaatgacttcatgctgcgtgtgaggtgggctttggaaacagaatcagtatttgtattcccacatggatgcttcaggccttaaaagtgcctcctcttccttatgactgccagccacatttactgagtccagaagacactcttttcttctcttaggggagagacgagatgtaaacagcaagggcaaggaaggcagccctgggaatcgtgtctgtgggtactcaactgttgctttatctaagtgggagctgcgtaagagggtcgagctggtgttcttttatcagcaaagccctggatctttgtctgggacctacactctcattgtattcttccaccagttagttctatggccttggcgcctgtggaaagtattgagctaatgttagtgcaaaatattatacaacacctatcgagggcgttttggcaatatttattaaaatcataaaagcatttactcttcaactcaacagggtatttagtcacagcattgctttcagtagcacaacactgaatattctccaagtgtgtatcagtaagacttcttatatgaatgtgggccacatgcaggaatctttggtaggagtaagaaaaggactgagggcgtgctctatgcattcatgtggagaggcctccagacacatcattcagtgaaaaaagcgtggtgccgaataaagtacacactatgctgcttgttatataacaaaggaaggaaaatagaaacagatatttgtattggcttaacatctggcagtaaaaaggaaaccctgagagtttaccgtaagggtccaggagattggggtaagatgggaaagggaggtaagtgagacttctttgtcatgccctattacataatgagatggatcctgttatagtattttgattttgaaccttgtgaacatatttcctattcaaaacaaaacaatttataaaagaatgctgttagagcactattgaaacatcatgaaaaaatgggctctatcaaaaggttgcgggtcttcaacagaagcagaatagatggaatcatcagatgtctttgacagtggcggctgcacgatttcccgtggttagattgtggttatcgaggatgatcccagctctttaagaatttgtttccagccagagagtcccctccttcctttttctttccacgttcctttccttccttggatactagctgttcagaaagtgtgagtggcaaccctgatattagaccactatattctactatttttctggtgtcaactgagggaaaatctattttgaaaataatgccaaacaccagtggttaatggcatatttgttcagttaattttaaaaaattattcatggagggtacccctggtttggtgtagaaaatcactggtatatgctcta

SEQ ID NO: 1275 - DNA, 1435 bp, Homo sapiens
catccgctgagccctcaaggcagtgagagaggctgtactttctgtatcagccccagctggaaagccaggcaaaccctcatcccttacagatggacactcttccggtttctgcctgttcttaaccactttccaatagttctttaagaaactttaaatagtttcttaactatttgaagaactatttaaagaagaactatttattaaatagtttattatctatttgaagaactattcaactgaagaactatttgccttcaaatagttctttaagaaaacatttttttgtccagagtttatacatcaacacacacacacacacacacacacacacacacacacgtgcacagacacatataattaggaatgcatcttgtttgtgtctcattccgtaatatgttactatcactcaaaatagtacaaactcgaccctaatatgacaacttttaattttggttggattcaccagattcaattgtttatttatctgatttcattatatcatgatttctccttaacattcatgaaaaggtcttttggggacttaatgtaagtgacaacagaattcagtgtgatgaaaccaaacatatatgaaatgaaccagatgccatatggttaaacctatgaatatgtcaaccagcaattcactggcgcataaatgtgcaaatgaggaaacgttcaaacacttcagcttgtattttacaaaacagtgtttaaatatttgacatagtttagtaatattttagaaaaatggcctacctagtctggatgatgtatgcgtttgctggggttactataaggaagttacacacactgggggcataaacagcagaaggttattgccgggtagtcatggagcctgtgagtccaggatcaaagtgtcaggtttggattctcctgcagcctctctccttggcttgcagacttccctctctatgtgtctgtatcccaattgcctctttttttaacgtttatttgaagttcatgggtacaaatgcaggtttgtcacataggtaaacttgtatcatgggggtttgttgtacagattatttcatcacccaggtatattaagcctacttcccattcattatctttcctgatcctctccctcctcccaccctccactctctgataggccccagtgtgcgttattcccctctatgtatccacgtgttctcatcatttagctcccacttacaagtgagaatatgtggtatttggttttctgttcctgtgtttgttcgcttaggataacggcctccagctccatccatgttcctgcaaaggacatgatcttgttctttttatggctgcatagtattccatggtgtctgtgtaccacattttctttatccggtctaccattaatgagcatttaggttgattccatgtctttgctattgtgaatagtgctgcaatgaatatacacatgcacaca

SEQ ID NO: 1276 - DNA, 1833 bp, Homo sapiens
caaagtgctgggatgaaaataacctttttaaaaatatatatatttcggccaggcaaggtggctcatgcctgtaatccctgcactttgggaggctgaagtgggtggatcccctgaggtcaggagttcgagaccatcctggccaacatgatgaaaccctgtctctactaaaaatacaaaaaactagctggacgtggtggtgtgcgcctgtaatcccagctacttgggaggctgaggcaggagaatcgcttgaacccaggaggcagaggttgcagtgagccgagatcacaccactgcactccagcctgggcaacaaaagcaaaactccatctcaaaaaaaaaaaaattcaaaaatttcttaatgttgccttcttagagtctgtataaccttcttctggaaagggcaattttttttaacatcttgcccatttattagatattataaaggttaagatgaaaatgcttcccaagggcctgccatgtttttcctgtcatataaatcatgtctgtacgggcagaatcacaaagctagaatgggtctgaggactcctcctctcaggcaacttccttccaactgtgggcattcccttgggtgccctcttacactcactgattcacccaacattcacttgggcacttctgcattgtatgactctcttgaggcaaacaggaaaaacctgtatctgccctcaaggggagtccctcctagaggaggacactagccataccgttgttatgctgaagttgcgaggtccatttacagaaccagccttatcacttagcaatatagcccacatacccataaaaaaattcaagggcctaagtgagtggatgataatgtggtccaaaggtgtgcacagacatatgctgagtcacttagtgggctgatcaacaggggattcatggaggaaaagctaacagaagtgaccactccaatgcattgatgatatcagagcatgacaggtcaagagagcctcctgcaagtcatcatctgctcaactgtgaatcggcatctgagaaaataagcaacaaccttacctcccaaacaccaacattaaagcaatgcattattaaaatggaggttctcaggtagtaaatgaacactttaaaactcatgcaatcataaacattagaatatgcagcaaagagataatgatacttgtcagaagatattaagacgacatggcaataaaaggaatctgttcacagagagaatgattctaaatacaaaatggtcagattgatactcagaagtattgctattaatagaaataatattagagaggtttcattatgtaaatggctcatgtgtctgccagaaatgtacccagtaataatttgcatttctgctatagtgaaaatttcagggatgtctctttgttggcttatgaaggaccctttcattggtaagccacagtttttataatcatgataagaaggatcacctatgctctttgttgataataataataactaataagacactcgtgtgtgcctggcactgcgctgactgccgtatgtgcagcagtcctgtgaggcaggattattattcatgttttaaagctgagaaaacagaggcttaggtcaactttcccagggtcttaaagacgataaattatggaggctggatttgaacttgagtctttctgactccatgcccactctccttccacttgcagcgtaaacacagtggctcaaactctgtggcttcatgaatataatgtttcacagggtatgcagtgatcttataagtagaaatgggtctagaaagatggacactcctggacactgcattgcaaatctcgctatctgctttcactcactgacacctatatt

SEQ ID NO: 1277 - DNA, 1637 bp, Homo sapiens
aatttacatggtatcatagccaggcacagtggctcacatttgtaatcctagtactttgggaggactgcttgagctcaggagtttaagaccagcctaggcaacatagtgagatcctgcctctacaaaaaatttaaaaattagccagatgtggtggcatgcacctgtggtcccagttacttgggagattgaggcaggaggatagccagagcctgggaggtcgaggctgcagtgagctatgatcgtgccactgtgccccagcctgggtgatagagtgagattctgtctcaaatataaataaataaatgaataaatggtagcatagcaaatgaaatatcatagcagtgaaattttgaaatatattttgtgttttatcctctgttagctggtatagactcagtttggcattttaattgttcagaatattgactttgtttcctgagtctatcaagcatgattcagaataaagcatgacttcactctgtaaggatgtgtcacccctctattttagatgtcattttaacacttctgaggggaagaacacgtttttattttaaggtttatttttataacaaatgacccaactgtagtatttttgaacctggtggcattttaatattagctgtttccttcctattgatgcaagaaaagcattcacttaaatctgaagtgaaatctgcagtgtaatttgaaacctgaaatgcttattgattatggtaaagaatggaaaattaatgactttgggaatctatgccacagtcaaattgagcagagaatgttctcctggtagggtgctttggatgctaacttctattagctgctgctcatttctaccactaaatatctaacaacactgttctcagaagtaactgaacttgcagaaatagctcatgaagtcattttctatttaaatagtctgcactttttagaataaatactctttaactaggatgatattaacgtatgtcttcgacagcaactgcattgagaagacagcctttgcaaaacactcttgtcccccatccaagtatgggtcttttatgacagattgttgtgtatctgaggaagctattgtgtcaacaatgagcatcataatgagtctaaaaatctgactcaatggaacaaatgcattttaatggcatgcattttactttaaaaggatgtaccaaaatagagcaagagtctgaaagcagggcattattttataatgaaagactaatatatgggtagttcaaactaaaggaagagtgtgactgggaatgaaaattgacttagggtggataagatcactcccatcagcaaaccacaaatgctgggggagagttagctgaagtggtacaggagcgaaaattaaagtggttaccaacacccaggaatgtcctttactgagatgctgacctaagtgggcagatggcttcctatggcactcttcacaggctggcattgcaatatcacatttactcactttaccaaaatgccatgaagttaatgctggaataacctgtttcttttcatgtttaaattctacttattaagtgtggtgtaatattgaggggaaaggagtaagtttagagactgagataaatttctaacatgtttagaatagcgcttaagggccgggcgcggtgactcacacctgt

SEQ ID NO: 1278 - DNA, 3441 bp, Homo sapiens
tgagatcacgtccttgtttacaggagacccatgaaacgttagaattaggacaccttttgccagtcaaggtgatgagcattaggatagtcctgcaggaaggcaaccaacttgctttggctccaggattccatgattccattcacaatttcacacgggcgagcgagcagtctttctgtcccagtcaacaaggacagaggggttactttcacaccagtcatggcctaacacagaagcttaatcctgactggaaggcaaagtgtgtttgtggcaaagccaggcagacgtgtaatgaaagcagaatgagtaatgtttagttaagcttctggatggcaggggtggttgggtgtatgtttggggatttttaatgactccaaaaggcgtcttaaaaagtcacactattttggcagttctgagatgcaacttttgctacaagtactaacaccagcaagtgactgctacaagtattaatactagcacttaccggcaacatttctcacaagcaccccttcctttctggggctcctgggatcaaaccaagttttctgcatatgtggggggttgggggtggggttggcacacacaccctttcccacctacagaggcataccatacaactgaaagtcagatcaaattgaagacatttatcatttttagggttaaatagtggaaaaggaaaaactgttgacacactttctaatttgaactacttaggtattgcaagattttcttcctgctggtggaaaattaaactaacaattctaagttaatgactgcagggtaaacggctccttccttataaaataaattgggtttatcaaaacttgtattaaaatggattttcccccaactttaacttataaatccaatcaagatatgactctagagaactcttaggctccaagtgaggcttcaaaaagtagggtgtatttccctacagttgcacattcagcagctaactccacatcaccaggtgggcacctgacacctggagggcaaatgcggggcagtgcccaccctcccttggtggagttttcacaggtgatgtcagaaaaataagaacaatgtagtaaattattcctaaagctgagtgttttctatttaaagatttttgttttgttcttatattatcttttcctactactttggcatcaagatggttttttcataaaagctttgtgatgagtgttaagagtttttaaaatgtcctaacttggcaaaataaaaaagactgggagccctaggtcaatgacctaaagcttttttttttttttttttttctcctagtgctttctgggtccaggcaatcttcatttgagaaccactagtttacagcactctctgagccaaggaatttggagtcaaccagtgctcatctaggtatcaaaatggtggcaagccccaagtgcaactaacaacctacagaagacggaagtctaactttagtcaacactcagggagtggggatgaagaatgtagtcttcaaagctcctggccactatggaacactgttctcctgctgcaccctacatgctcacccctccatcgtcaaagcctcctcctcctggttctggaacaggtggtaaagcttttggaggccctgtgccaaccagtgctctccgcaccgttaatctgggaaccccaaatcaagatgcttgaccctcctgggattctgagaggtcagccctgtggcaccagaggctttctggaatgattcatcatattgtcagctgaaattctactgaagtggatgcccaagactagtttctcagtactgcagtatctcactcaatcccagtgatccgaaaatccatccatcctcccaggacagtctgactgtgtagctggttcaggaaaccaaaggcaagcgggggtcactcatccctccagagcctccagactgagaataaggaaaaaaatcgctaggtgcagtggctcacgcctataatcccagcactttgggaggctgaggtgggtgaattatgaggtcaggagattgagaccatcctggccaacatggtgaaaccccatctctactaaaaatacaaaaattagctgggcgcggtggcgtgcgcctgcagtccctgctactcgggaggctcaggcaggagaatcacttgaacctgggaggcggaggttgcagtgagccgagatcgcaccacaacactctagcctggtgacagagcgagactccgtctcaaaaaaacacccaaaaaaccaacaaaaaaaaccccaaaaatcagctgggataggtcatgaggtcatgacaggccatcaactatttaagagatttttcaactaagaatataagaacatattgccataaaattttaaaatccctatattctagaggttctatctattttcagttgtatgctccttaaacttatctgtatttaggcttcccccaaaatgaattctaacagaaaaaaaaaacttcggtaaaaaaagaatccataaacactaaatattttaatacctttatttacctcctctctaacagaactaatcagcagcagataatatatttgttacgaagagaattaattttctagttaaacatgcacataaaaacataaaggtgacaatatttggcaatatatgacactaataaaggtaacatttattgggctatccactgggctaagcgcttgactcagatcacctcagttaatccttacagcaaacctataaagtaggtgctattcttatttccattttatagatgagcttataaatgaggaacctcattactgtaatttaatcttcaccaacccagaatttgagttcagtgtttactctggctattaaaaggttgaataagcaaattagaaattaaacgggatttcagaagatatatttaacctactagaaggtcgtacgttttaagacatactgaaaaacagatgctaactgcttccaacaggatgtgtttgggaagatcctgcctgacactataccacattaaaacacttgaagattcaaacttttactagttaaggttgagtgtcctctcactattatccccaatgactggtccaagttagtaaggtattattctacttctatgggtggtacagtatggtggatgtcagctgcggctcccaagttctatttccctcctaccctgacaaagtgtccagaactctacacacccccagcctccccacagcctggtgcaggagccagtctggtgcagaagccagcctgaggatgaactgacccagggaggaaggagtggagagattaaaaaaaaaaaaaaaaaaaaaaaaaaaaaaacctggatggtttaggatactgctgagctgctggttcacacccaccctgcagtccaccctatccctgcacatggcaggtacatgagctgattaatcaattcattgtgccgtgggagcccctgagttaggttttctggtattcagaattaggatttttggtagtcag

SEQ ID NO: 1279 - DNA, 1926 bp, Homo sapiens
caggtgcgcaccaccacacctggttacttttttaaatttttagtagagatggggttttgtcatgttggccaggttggtctcaaactcttagcctcaaggatccgcctgcctcggcctcccaaactgctgagatcacaagcgtgaggcaccacgctaagcctaatttagtgactaagagatatcttaaatatatataaaccttgtgtggataaacagaaaaaaggaaaacattcggtgatatttgaatactgattgtatactggatattgaattactggtagtattttgagatataacaatggaaatgtggttatattaaaagacttattactagctccatattgcttttgatttgggattttcgtctctatgtttacaagtgatttaggcctataattttcctctttggtactgttaatgtctggttttggtatcaaaataaataagcctcataaaatgagttatggagcactacatttttctttttttttttcccacgcttaattcactttatttttcttgtataaaaaccctatgttgtagccacagctggagcctgggtctgctgcacagagactctggtgtgggtcttgacgaggtggtcagtgaattcctgatagggagacttggtaaatacagtctccttccagaggtcgggggtcaggtagctgtaggtcttagaaatggcatcaaaggtggccttggcgaagttgcccagggtggcagtgcagccctgggctgaggtgtagcagtcatcgataccagccatcatgagcagcttcttgggcacaggtgcggagacaatgccagtgcccctgggtgcagggatgaggcgcaccagcacagagccacggcggcctgtcaccttgcaggggacggtgtggggcttgccgatcttgttcccctagtagcctctgtgcacggggacaatggagagcttggccaggatgatggccccacgggtggcggtggccacctccttggagcacttaacacccagaccgacgtggccactgtagtccccgatagcaacaaacgccttgaacctggtgcgctggccagcacgggtctgcttctgcactggcataatcttcaaaacctcatccttgagagaggcccccaggaaaaagtcaatgatctctgattccttaatgggcagggagaagagatagatctcctccagggacttgatcttcatgtccttgaccaagcggcccagcttggtgacgggcatccactccttatctttggccttgcctccgcgagctccgcggcctcagccccggcccggtccacggctgcgaccccggccccggatgccactggcgaaacctctgcggaagccaccgcggttccccatcccagggccaccagggcctccaggcccccccactgcaccggcgtcatccgccatttggtgttttctcggagaagaagctacatttttctattcttgggaatagtttgtctaagagataaattatctgttccttgaaggtctgggagaactcccatgtaaaatcatttaggcctggagttttttggtctaatttaactactaccaatataattaatatgaagttatatctctttaggttttctatcttgttgagttagaataagttacattttccctggaaattatccatttttaaatattttatttttaaaaatagaagacggggctgggcacagtggctcacgcctataatcccaatactttgggaggccaagatgggcggatcacctgagatcaggagtttgagaaccagcctggccaacatgatgaaaccctgtctctactgaagatacaaaattagctgggcatggtggcgcacgcctgtaaccccagtactttgagaggccaaggaggggggatcacctgaggtcaggagttcaagaccaggctggcaaacatggtgaaac

SEQ ID NO: 1280 - DNA, 1620 bp, Homo sapiens
agtaagaaccaaacctcctgattccacagtacagaagtttctccactgaaggatccttctataattaaaagcatctggtgcaggcatgaaggagcttctcaaagctgctttattttatcacctatctttaaatttcatacataaaatggtagtatgcaaaagccagatgacatgattctacatcacacggtttcattttgtttttgctgccccattatttgaacactctactggattgctagagaaacataacctcatcaaaataatttgcagcaaactttaattttaatatatctgtttcaatgcaatatttcattcttgctatagatattaaacattctttataatacactgtaacatgtcacagacatcactgatgtttgctcaagaatggcaagaacactgtgtctggtacagtattaagataaactcaatgtatttcatcttccccgtggatggtagatatcttaattgaaatgacctgataatgttaaagtgacaagaaaaaatacacagtgggaaatgcaaatacaataaaaggtacacagagacgttgctcccaatttaacacacttgagaaaaaactaatttttgacagcacctgttataaacaaagctacaggcacaaaaatataaaaatttggtccattgttcttaaaaacattgcctgtcattctcccttattgcaacacagattaatttcctataattttgcaagtagtcagagaattcaaggtgactatgtcaccccatatgaataagggcaaagattctcttctttagagagattatataaagaaaacaatctaacattcttcacttacatggaagtactttgtggaggaacaattaacttgctaagtgggtgtctgctttgactgaaagatcagggctatttgaagcaatagccctgtaatttgttacataagcaggtatttaggataagtcttttcaaatgcatattgctgtgtcaatgcattgttaaaaataccaataataacatacacacccccaaaataacactttctcagaactggagctggcagttgcctggacctcattggagctgtttgcaagaaaatactgagagaggttctgaaggaatggaatggcactcagggacagggctactcaattggaaaaataaagagatctccctagttttaaagggcaatgactcctaccactctctccaacagcaatttgaacatgacctcacagctattgctcatccagaacagacaataagtatgaacctgagggagacattagaaaggtcttctgtatcaccctaaggaatttggcatagtgaccattgaaaatctttaaaactatctgatgagatatgtgtgttagaagttctttctggtagcaagcttcttttgaaagaaacctcctgggctggaaagtgttcatggcttcttgttctgagtgggaattagtccctgactccctgggctagaagtctttcttcctggctggctgtgaggtttctttgttcactatatttgatactggcttcctcatgggaacttcttagtcaactgaagcctttcatctcaaacccttactaacgatatgttttgccagctttgtccatctcctttttgttaacatgat

SEQ ID NO: 1281 - DNA, 1378 bp, Homo sapiens
tcatttacattaggtgtttctcctaatgctatccctcccccctcccccgaccccatgacaggccctggtgtgtgatgttccccaccctgtgtccaagtgttctcattgttcagttcccacctatgagtgagaacatgcggtgttaaggacaccagtcagattagattagggcccaccctgattcactctttctaacttaatttcctttttaacagccctatgtccaaagacaatcacatctgagctactgggtactaggactttaacataacgattttggggttggggggtgctgagatatagtgagcctataacaaggaatcttgaaggactatgagaattttcttttattgaaggggtctgtgtcagtcatctttcttcaggactggacctgctgtgactactgcctgtagtcttgtaagggtctaaacttgtgatgtgtgcaggcttctctcacatggtggcccttaagtgtatcagccaggcctaccaaacttgagggatcactcattaccttattcctcacttaagaaacatctcctttctgaacatgatgatgattttgtcacactgagttatgatatttttataacattgggtgttctcccaggctgtctctggggaaaaaatcatatttaatggtgttagtatcattaactatttttacctttcatttttaaaaggggactgtaggcaatactgagctcatgccccaaagcactaaagattggatgacttattctttccacttagcttcatcccatctagtatacctcacagcagaattactctgttgcctcttgttggagtccttgatcctaaaggtaactcagaggtactgagagcgttgtataaaaaattccccatctgagctattctgagactccacaagttaaactctcttacatcatggcaaagcaatgagattagtatgaaagacaatgattcctggaacaatgttcttacgcagttttcacaatgagtcagagctataagaagtcttttttaaaatgtgttcttaaagacttttttcacatggtcttttgtgaccacgtgactattacaggcgtacgccaccattcccggccgacctagtgagtattaggatatattagtttcaattatctgttctcacattccttttggtctggcaggttgcagtgggaaagcaaggacagaccagccctgccatcagaagccctctgaataccactgtcaggtcaggtcatctggcctgctgcagaccccactattgaccttgatatccttgtccttcagatgtcgccctatcttttgtcttccagttttccagtggctcagatttttgactctagatcatattcttcttatgccttggtttctgaaacctgctagatgg

SEQ ID NO: 1282 - DNA, 2467 bp, Homo sapiens
tttttaaaattcatgttagctagaactatggtaatgaatctagaatgtaatgctattaaaatattcaagccacaattcccaaatatttctagatataacttagtgacaatctcggagattgaaatagattattccttttcattgcaaagcaacagtttggagcttccagtagaataacaacaaaaatctgggatgaaataaacaccaattgtgaaattatctgaaattatctagcatgagaatgaataattactccaatgagtaaaatggttgatagtctcaaatgaatacaaatataccatcaaaaggaaatcacataatttccaaacacttacttttttgttgtggtaccagaaattccaagatctataaatggataaaagaaaaaagaatgtaaatctctacactcagtttatatgatatgacatttaaaagatcaaataatcagaagtctataaaaaagtccttattttgcctaggaatgactgcattcagttatacagaaaagaaactatattaggaaatattttcataaattaaagattttcttttacttcatgttagacttaaggatccattttaatgtcaactggtgtccagaaaagagcaaacatagcaggtttgatgctgctattttagaaaggctgctatctgggaacttggttagtaaattgttctctatactaggataaaacttgccctaaatgataaaagtggatcactgtgcctacactactatttgtacacatgatatggtttatgttgaatatccactttcattctgcaagtctgaaattttggcacatgccaagcagaaatgcctacatgatcactgcccaataaatactctgggtgtggagtctctaaaggtcttctttaggcataaacacctcacacatgctgctgcatttttgttgctgggtgaagagtgtgttcttctcctcaagggagagacatagcttaaggaagtctgcatgtggactcttctagactctgcttgtcttttccccttatcatcagccatatatccttcctctgcttccgtaataaatctcagctgtgagtacaacgatgtgctgagtcccatgtgtccttctagtggctctgtgaatcccttgacatagtcggcttaatcaatctgctctaatatcaattcatttattacttcagaaaatattttgtgagcatctacatatgccaggcactgttttaggcacccggaacatattagtaaagaaaacagtcagagagtcctatcctggaggaacttgcattccgatggtgtcagacagatgacaaaacaattaaaaagtaaattatacaggctgctagaaggcgataaggaaagcttatggaaaaatgaaaaggaagggcaaagtaagtggggttgaaggggtaggataaacatggggccagagaatattatacagggtgcttggggaaggattcatagaagtgagacttgggcaaagctgagcagagtctgggtgagagctttctaggcagagggaacagccaggacaacagccctaatcaggtgcataatcaatgtattagaggatgaagttaatatttatttcttaccaaatcttggcattacaaaacagaataaggtatatattaactgaacaccaaatataaaaatgattacccataattttagtttttttaaaagacaaaatttattttaaaatttatttttcaattagactataaaactaaatatatgtatattaaatgattaaaaagctaaaccaagtatttatgcctgttcatgtgaaaaagcaaaagaaagcagaagtgtaccttacatatgtatacatgaatcccttgtcaaatttcatggcagacgggaatgagttacctgagggcctgggcctctgttgcaagctaggtgtcctgggaagaaggctctgggatggagattagcatgcaggagatttattttgaaagggaagagaggaaactgtgattgggcaagactgcaatgcagtctcaatagaagcgtcagctaacactgaaaaatgttttataaaaacatttttcttgagatataattcacataccataaaattcactcttttaaagtacgtaattcaatggttttagtttattcacagtgctaacatagaacttttttgtcaccacaaaaagaaaccctgtaccaactggcagtcactcctcttcctctccacttccctcagccccttgaagccccaatctacttcctgtctgtatgcatttgtctattctggacatttcatataaatggaatcatatatgaaaacacatagtcttttgcgaccgacttctttcacttggcatgttttcacagtaaatccagttgtagcatgtatcagtacttcatttctttttattgccaaagaatatttcattatgtagatatatcatttttttttatccattcatcaagtgatgaacattagggtggtctactttttggtta

SEQ ID NO: 1283 - DNA, 1708 bp, Homo sapiens
tggccccacgtgcatgtgcactttcatacatgcaaacattcacgcagacatttctgctgagcacagaattatagacaaaaaaatgtcaccttgtttttctgaaaagagatttatcaaaactctctgtgctacagaaacctgtgacttgggtactagattaattttggttgcctctaccacctctaggaaaattagagaattctactttaaaatatttttggtggatccataggtgacgtatatcctagagaaggaggagactctctcatcaactaatttattttaaaaatgagagccaaataactgatccaatgtcagccatatactcacattgcccttttaatactggctttccaaagatcagcttacactggtggctgaatctcacaagtagagaagatatcacaggttattaacctcacctcttatcctatcttgattttctcttcatcttgatataaaatttaccttttaaataaatcctcttttgttattgttataagattgagcaaagggacaactcaggtcacttttcatgcacccccactaaatatctggaacttacatgtggcaggtctgagggtagtttttgttgtggttcttccagtcctgtgtgtttatccccatttgtgggaaatagacacctttagttgcaagggcttttcgcttttggaactctgaagtatgtactttaaaacatgtgtttaaagatgattaccagagaacaaatcttatgctaaaggtgaacataataacatttaccaatctttcaatttcccaaagttttaaaggaacaatgaaataatgtattattatcatctgtgataagctgaatattgttttaaaaatctgtcaggttttttttcttacagtatatgagcctcgggcctcatcagatttggttccattgaaatatatttcttagaagaaaaaatagcctatgtgtcttacataagtctgtagtcagctataatggttaatgtgcaatctcccttgaaagatctgtcttacaaggaaaatgttgacgcagttttaattatagcactcaggtgagcactgttataatttttaatattcctccatggtaacattttcattgttctggtaaaggaaaatgctctgatgctgcgtccctagtttctggtgcttttcgattttatgggaaagttgtctttttgaactgaaacttttcatttggtctcaaggaagagaatgtaactataagatctgtcacatttatttattagtatacacttttctctctatggcagttgctattctggtttatgacaccattatttcaccttacatgattcacgttaaagaggtgagcttctgtgtagtattgcatggcaaatcgcaacacctgctcacttgcattagggaaacatcacatttttaaagaaactgtatgtaatattaaaaggataacatgctaaagttttatgtttattagaattcaaggcattataaaataatatctaaaacaatgtactttaatatagaatgatcactgaactcttccctttgagaacacaaattagaagataaagagcatgctcgatactctgtttagaaaggaaaagattcgtctatgcatcatcatccattctattaaaacacgctttcctggcttcctacttcttgttgcccaagagctcatcaacatgccctgctgtttgatggaggttcaggagtgagtttttga

SEQ ID NO: 1284 - DNA, 2532 bp, Homo sapiens
cccgcctttttagggtcgagtcatgggtcgtctccatcttggctccctgaggatgaggcgcttctgcctaacttcttccagggctcccagacttctcttcctcttggctgcctcccctggtgtgttctggagaagaatattcactctcttgacaaaggaatttaaagagtgccagagctgaggggggccagggccacattgggaactgagtacttgaaagtgccccctcggcggatggcaggaaaaggggagcattcacacacaggggtatactgttgaagaaatgccaagtcctgctttctttgattctctttgagtgtttcttcaaataaggtgcccagcagaatggcttcttaccttcgtataagaatggcacattctgctgaaagatgttgcgccaggaagatggagataaaatcctgaggaaaccaagcaacgagaaagccaggcaacttcaccagcagagggcgccagaccaccagcggcgcctcacaggaagtccgggtctgtaaccactggtaactctggggacaatgaagggaggggacactggattattattattgttcccatgttatttattaaacctcatggccagaacactaacaagcattgtataaaaaaagagcacaggacttggagtctgaaaagccagattctagcattttgtagctttttggcttggccaaacacccagagcctccatttattttcttacctatgaaatagaaggaaaaaataataatcgtagcaatggtgtgtggcttatcaacttcacaggtttgctatgaaggctgataaataaaagggaaaaaaagatctataagcacaaaccttagttatttctggggttgtgaactcaaaagaagtatattaatcttaaagggcaactcactcctcatgccacagaatccggatgccttatcacgtacttcggaaagatacttatgttccagcctgcacagatagtagggatttgtggagtagggagtccattcagagaggcaccaaatcccactgggtaattaatggtacacgccattccaccccaatctcgggtacttaagtgaggccggcaacagagaagattcttcacagtgtgaagaatccagggggaaagatctaatagaaaaaccaaatccagggctgtccttctaaaacaattactggaaaattgcagaaccagtctgccccagggaacctcaggaaaaatattacttcgattgtgtgattgcatctttcacagagcatgcaagagcactgccgggcactgcaaggcagaagctaagagctccagtagttatattatgcctttgtgggattgctatgcttagcttatattgaaagcagcacaaaattaaaatgccaaaattaaaaatcacaaattctgaactcaactacaggacagagttccaggtgatttcattctattttcatgtgatgggctattaattgcaatcactgcacagaatttttatttaggacagctaaggtttctcttgcctccaagccccaaccaacgtagtcctctctgctggagaaatttctctaaccaatcttcctgtcatttgcctcgtgggctcgttcaaattgacacctgagagttaatttacaccttcctgttttacaaaaacaatctagaaggtacctagcgatctatctcatttgaattaaaacactaaatttcagttttcagtcttatatggattatataaatgggaacccttggggagaagcccagatgaactaggaaaattttactgtcctttcaattattttttcaacacatctgtgctggttacttttaaatctacctctatctcttctttaaaatccagctaacaaacaagtcattataaatagtgcctttttagagaaggaaaacatgtcacctctcaattctgctacaaggaagtcgttaatgtaggttactgaattagaacaatctctggagtagtcatgtcttttctggtccttaggaatgggtctagggaactctttaaattgtaactattatgtattgcaattttttaaagctaacatgtatttattttaagctcaacatagctttattttggatctacatagtagtgtgccaagtagtgtgacattgcttgttccctcccttctggggatatggcagtaccatgcctgctcctgtgaagttgggcagggccaagtgaaatgctttagacaaggacatgagagaggaagtccatgtgtcacttcccatcagaagccttggaaagcccatgcctgattgaccctgttccctcaccctgtcagagggtccggcaatgtaccatatgttggaggctccaacagcctgatcctagggaaatcctgaatcagagacacctccaagttggacacgcagtttagacaaatgacaagcaataagtctttgctatctcaagccactgagatattagggttgcttataccacagcataatccagcctaccctactgatgccacatcagaaattcttgcctcaacaatgttccatgacccagacctctgtaactggta

SEQ ID NO: 1285 - DNA, 1311 bp, Homo sapiens
agcgcttgccttggtcagaccttcccacatctacatactctcaaatacatgaccaggtgatcaagcaatggaaaaatttgcaccaccgtgtcccatgaaattgtttcaatgtttagtttagatattgctaacttgtgctattaaccttttgacaagcgtgtagtattgtttgttttgggtttctttttgatttataactatttagtagtccccagctagctaccagtacagattttaccccatgggtaggattctattgttaagccacataacaaagcacactaattctgacaacactgcaaatggaaaatacgaaccaaaaaaaagttacaccgataagttcaacaaactgtccatttttgatatttgcatgctcccctatggactggctgtggcaatgtaatgcctgtataatgttttcaaataaaaataaatgctttatgaaagcaccgaattcttggttttcttttgtgtttgtctgcactatgacaaccgtggaagcagctcccttgggatactagaaatagcaacaaaagtagatggctgggtacatgtcgaaataaaaaccagaaagaaaatatttccaaattaggaagggcacaattggtctcagaagtatagtttcaaaagccaaattaaacatgttcatagtttgcaaagttaattatttatctgggtacataagaacactctggggcttcaagcccacatttaaaacacatgtaagacaatataaatttacccccaaggaaaagtttctcataaagaagaaagttctgtgtatgctggccttggcacacaacagacttaacggatgagcattcttccagagtgcaatgtttataaagcagagattgctcagatttctgctcagaacttacacagcatcttataatcatccctcctctactaactgctgtcactccccataagtacctagattataaatctatccccataagtacctagattataaatacatttacatgttcttgtcagtttttgcaatcagacctcaaaaattaaatgagccaagaagactgtgtgtctgagttatatattaagaataatgtttaaagaaaaacattcatttttcaggaaaaaaggaattgtaggacactaagtgctttataaagtgctctcaggttgagatccatcatgagctgcttttataaatagttggaatagcatgtacttaacataagtaatttgcttgagaaatgtgactctcagtttaaatcagtttttttccttgaaaaaaatgtcaatctttctctaaagtattgtttacttccatttagtaagctcttt

SEQ ID NO: 1286 - DNA, 4272 bp, Homo sapiens
atcaccagctcaaacaaaagtctgttcagatatgttattccacttggtgttcatccatattcagtcatctcaggactttaaaataaataaaagtcacaggctctgcatgcttctttccagaaagtagaatctgtattctttagatgctggctgaaagggctaatttcaatgagtaccccaaaaaagaaagcattttattgcctcatgaacattataattacttgtttacacgaatatgttttattcatttaaccatctcccaaccatactagcagaataactactttaagaaaatacctagtaaaactgttgaaaaaaatgagccatcaatggatttgtccttaagcgactctagccatctctgtgttgaattttcacggtttgaagcagcaactgcagaaaagagggcatctgcctcagtcattgatcagctggcatgctctccatgcaggcagaggttcaccattacttctgttgcgaaatgtccccaacaacaccgtaaagccagtcacttcttcaatttactgagttaagctgatcatggtggtgagtgcttatagtcccagctaatcaaggtgctgaggcagtgggaccacttgagctccagagttcaaacccaggctaagcaaaacccctgtctcttaaaaaaaagatatatatatatattttaactgtatatatatagttttgtatacatatataaaactaaaagaaaaaagtaaaacaagaaaaaatttactgagttactacacagttaagaacacataaaaggtgacctcaaaatgtggatattcacatctgtcatcctacttttcattgaatatttaagcaataaagtgtaatgatttgaaatatatgcattaaattgagaagcattgttaatgtaccagggaaggcaggagaatattttaatgaatttgaaatggctaaaaggaagctttgggtcctcaaggaaagatgaattttaagcaatttctcacagtgtgaatcgtttataagtgatgcattttgatgcagaggaagtgaagttcccagaataaaaccacaaatctccaagaatacccttagtcaccaacatattgcttctttctcaaaaggcaaaaatctagcactttgctgtagccagatcatgtaccacacatgaaaaatgcatgtatatgttacacctcatctccaaacttacctatggttatttgtatcttatacaaattacagtttccctgacatatatctaaaatatggaaaactcttcaactccttggaaatacatttttcttataattagacatttcttttgtccattaatagcaagagcgtcttgtcaaggatcatggaagcagaactgattcaagattaaaaagatccgtaaaagtcacatgagatgtaattcttagaaccagtatagagttttatcaccagctgctaggaaaagtcagttcaaatatggaatggttcaaatatgttattctacttggtgttcgtccatacccagtaatctcagtattttaaaataaataagtcataggatctgcgtgcttgtttccagaaagtaggatttgtatcctttagatgttggctgaaaggactaatttcaatgagtacccaaaaaaagaaagctttttattgcctcatgagtattataattacttgtttacatggatatgttttattcatttaaccatctcccaagcatattcacggaagcagaactgattcattcaaaagaaaaagccaatttgggatgggggtagtgggaggagatctcttcagatctctcagttttaaagtctctgatggttggatatttgtagtttttcactgatttttctctctgcataaagagctaatagctcattgtctataaatattttccaacattttgttttccaaaatggactcatttctacataaagacgtcatggaaagatggtttttcttcctgaagggttaggtcagccctgggaagaagtatagaccttggctcctgttattcctctttagatatcccagggttccaacaggaagttacaagatacctgcactacctgtaaagtttatttaaaatgattggaaggctctcataagcattggaggggaagaaaaactttttttctaccctcttaggtgaagtgcctaggagcctgtgaattaaacttacagcagacagactagcaggagaaaaagcttacaaagttatttattttaaattttgcttgcacaagggtgtcatagaaagaaatgaataccccaaggagtgatgagatttgattttctgtatcattttactacaggaaagggaggtggagaaaaggcaatattgagagagcaaatgacttctttaaaaaaaaaaaaaaaagataaatgggtccttaggagaatagatgggagatatgacagtttgtgacaatgtctagaagagaagaaagagttgctcccagtgggaggaatttgtgacagctgagttcttttgggaacctctgcttttagtcagataaaggatttcgggaactcaaatgccttcagctcaaaataactcttatgggctgggtagggtggctcatgcctgtaattccagcacttttggaggccgaggcaggaggactgcttgaacccaggagctcaagaccagcccaggcaacatagcaagacctcgtctctactaaaaataataatttttaaaaattagccaggcgtggtagtgcatgcctgtagtcccactactcaagaggctgaggtgggagggtgacttgagcttaggaggtgtttgtcccactgcactccagcctgggtgacagagcaagaccctgtctcaaaaaacacaaataaaacaaaaaacaaaaaaacacctcttatggcaaagtggcatattttggggtggaaaacgctgattcctttcagcacgcatcatttgctcatgttttacccaatatatgaagggcattaccggaaaggaaaatacctgtttactcttggcctactgtgtatctggtgtggcttcattcatttataagatgttccaccaggctcttgtagcccattctcaacaacagtagccttcaaagaaggaagtatattctgagattaggacttgtaattttcacgtgacaatttagagaatatgtagaaataagaatacacattcagaacgtgtttgaaatattgttacaaatgtttctgaatttttacaattttcaaagaaacctgcatgtagaaaatatgagggtgctattcatcagtcagaagacatgtgattacatcgtgcagtgcttaacacatgcactttacaggtcctcctaccagtaggagaagacaccaagactccaggtcctcctttacagaagtcattgtggcatccacagggtaggaaagccccatactcagcagtgagcaattttatacatttgcaaagcaaatcttgtactaaaaaaaaaaacaaaaaaatggggtgggttgagtaacagtaaactatcataaaatatacatctgaaaagagattcagacatactttagaaaagaattaaagtcacaatatatttgccacctcaaattaaattcatttgattatggggttggtgacttctttcattaagtgatggggaaatagatcagttctatcaagcactgccagtttatcacttactatctcaaatctttcagttagacacaaatagaactttgtatgacctttgctaatggagagcaacagtagaaaattattcatcccacgttttgggtacttactattaaatatgcttgtttgcaatgacctaggaattcacaacatatgcaagtacaaaacctaccttattgtgacatctggcctcaggaagagaaagaacttggtgccagtgttctttgactcttgacccatcataacgggctcagtaacctctcccctcagatgattccctgagacccaccacagggatatcttctcttcttagtaccctcttctctgagtaccctcacccctcaaatgatatcctgagactcacctcaagggggatcctctcttctcagtcccctctcctctcaaatggtgtcctacacctgcctctgtagaacttgcttctgtccttctcagatttttttttttttttttgagacggagtctcgctctgttgcccaggctggagtgcagtggcacaattttggctcactgcaagctccgcctccctggtgtacaccattctcccaccccagcctcccaagtagctgggactacaggcgcccgccaccacgcccagctaatttttgtatttttagtagaga

SEQ ID NO: 1287 - DNA, 2947 bp, Homo sapiens
gcactctcctttgcctcctttgtaaaagcagctgcgaacttctggactctgaattcaggataggagaagtagtaaacaggagagaagaggagaaagggacaggctgagaggggcatccagggagcttcagctccctgttcattttcttaaggtgggttgtgggtctgttagtatttgatgtatgataatatactagcctttaaatatatgctacatatattccttggaaaatataaaatatttcatagtaatgaaatgaaaaaaaaaagtttcccaggttaattcttatggtcagccagattgtacctgaactgttggttcattagtctgctctttttccaaacccctatgcccctattacctatcttctgaacttacacactctcactctctctctctccctccctccctccctttctttctctctctccctccctttccctcttctctctcccctgtatctccacctgccacttcctcccactgcctccctttcccttctggctgggtgtcccatttctgcaaaacctcctactctttcctcccacagcctgggcatctgtgaggagggaagggctagtatgagcagaccatcaggttaattctagaccaaagtttcactttaagattgtccacatggtccctaaatcctcagatattattataatgatacgtctttaaaagtgtccattacctaactaactgcaccaagtatttgagactattcacaaaggtgcatagaatatagaaggagcaaataacagttgagagaatcagaacatagttctcaccactttgctcagttgtgtttgtattaaattgctctgttatcaacttaaattggaactatatttcctagaatccctatccttgaggtgctgcctttacttgactagctctgggtaagaactgggttaaaagaaaccttgtgcaagaattgtgagactgaagtaagcagcagcctccttttctgaaggtcatatggtcagaggtgctagcaggctctagcttcaacttactctcctctgcttccattccagccattcttcctgacttctgaccctctgaccagcagcggccccaagcctttccttagactcttggctgcagagccatagatgtttttcctgtaggcttttccacaatctccctcttggcaacccacttaggggctggacatatttggcttcttgaaatgactggctaaggactcttgatcatcactcccctatcagaccatccatcccccagcaccctcctcctccccacaattgtgaaaggtttaattcctgtataaatccattgtctcataattcttggtagttcagcttcctggattgataccatgatagataacagtgttcaggaccaaagagagacagcacaaatctgacattctctttgaagcattgactgcaagcaccgtagagagcatctaatccaccagtttcattttatagatgatgaacctgaagtgcagggacattcagttcaggtcattatcaagatcacccagctacactggcaagtataggaacgggacccagcttactgacttgaatggttttaaaattttatttaacaataactatagcaatgttttaagttacttttaaatatgtttacttttcaaaaaaatatgtcaaagcagtaattaacactttgatgttgcctagaggcttattttagaagatagagaactgttatgattattttgtttagtatctgacagaaagctggatggtgtatcagacaggttctaaatttcactatctttaatgaaaatcaataatgaaggctattagaatgaaagaaaatacggccatataagaacctcaaagttgatcctgaatctaaagttactatggcagcattactaccaaaattgtatatattaattttgtggttcactaaagatattagcatcttcagtatttaaaataaacattagattcaagatgttcctatttatatttttaacaagcagatatgtagaccagggagtatattttagctgtcattaagatagacacacaaatgctgaaatttcctcacttctaactcagaattttcccccttacaatcacatttgcatttataacaatataaataggatgtgtgctgattgaaacagcagtaattgcatgaaattattttttgggtgtgaaaggacagaaagactgagattgtgcaaactactgtttatgtggttcctgggcagggccctgggtaagatctgagcctggctgtcccagtgctgagtcccaggactagtcctcaggctgtcctgggtagagcaaagcactctgaatcccatccctgtgttgtcgttccctaactgtataaccctgagtcaatcatgtcacctgtcgttgcctcatctgtgcaatatgagagtaaatctgggtaagctctgaagtatccttctgttcttcaatcccttttttgttgtagtgtcaggctatataataatggtattaatgaaatttgttagagatatcgtactatatagatgtatcctacttttccctaactcattataattctgacaaattttcaatcactatggcaatcactaacaaaaagtaacttttgaggggaacctataatccaggcatgattcaccatcagagcttttcttcataaggtaaactgagccccatctcagataagagtgagttttgtcagctcacgcacccaaagttctgtgtcaggcattcctggagcacggtgatgtgggtgctatgtcacaaccacctcttcctttgtcttcctctaccatgagagtccaaaatgctaaaacactcagctccccaggcagtcttgtttctagagtggcactgtggcccagttctagccaatggaatctaagccgaagtgactgagaagggctttgggaacatgctatggaagagacaggtgagctgccattcctcttcataagatg

SEQ ID NO: 1288 - DNA, 1723 bp, Homo sapiens
cccatagagccacatcaaaatgttgcctcatgggtggattttttacctttatgttatttgcaagtttatttttaaaataatacatatttccccaaggattctgagcaataaatatttaataactattctgtaaaaggaatacagtgatgaacattaacagtccctggcctcacaaagaatatagtcataaaattctgaaaggcctgcattgtacttacagagttttcaaaaattatgcacattatttattgatacatttattacccattatctttataattattcatttagatacctatgcatttacttctaatataatacattaatttgggttcatttgcatgttaagacttctgaaaaatcttttgtactaagattataaaatccttagaacaataaattgtgtattctatttatttcccccctctctctctctctgtatgtaaaaatcccataatagaattaaatggtactcaagaataaggacaaaaagggcaattataattctgacaactcaatcccaattcagaaggaaaaaaggcatacacgaagctttttgagactgaatcagaattctaaattattttaacaggctaaagttactcatgataaaaattaactttttcattcatccaatcattcaattaatgtacactgaatgcctactatgtcctagataaggagtcctttccttcactgactttgaaatctagtgaataaagtcttgtttctataaaatccaaaaattgaactaggtgataaacattcttcccaaccaaaactcataatacctcactagtttagacaaaagaatattgtaaggaaaaaaaaaataaataaggttcctgggtttatatttttaaaaaaatataacttgggaaaagaggaaaaaaaaggaaaaaaagtatatatatataaaaatctattgtttatagtaaaaacctattgtttatatttgataacagcgtttatcattttggcagacaaaatacatataatttataagtaacaattgaaaattctgaaaaattttagagtttaaaaattaatggctttaaagcaactcacttcccttgtctataaaaactcctggaaggattctagagactttgataagaacaaacaagtgctaccaaggtatggtttatttccatttttcactacatatttgaaattctacatatgtttcatatcatatgtctttgctacaatggtccaatttacgtctttgctacaatggtccaatttattcaatatgaaaatccaaaagagtttaaaaatattttagttattaaaaaatttaattaatgattccatgattcggggactcactccaaaatctggttacctctgccacctagtggtataagaattccctatctcacagtgctaggtttcacaaaatcatagggttttttatgttaaagtagctataaaatatttatgtaagaaaactggcagtgaggtagagtaagtaatacacacaagataaggccagaatcaagcctaatttctcattttgtctctttgtactatgttatactgaggatatatgatacttcagtgctaatgatatattatgcgaaattgaaacagtctctttcttacagaagcaacagtgatttcaaaaacttgggggtgggggtggggatgagggaggtactcaaagtcttacccaggcacttcaaatcccatagtttgcttctttccagatacagtcatt

SEQ ID NO: 1289 - DNA, 8494 bp, Homo sapiens
gttgctttttgaaagcatttctgaatctagatgaaaaacttcagccttttcccctaatttatctttcgtttcaattggagaaaggtcttaaacttgtgaaaatcctgtcattctcacacatttcatcttcttcctccttctaaagaaagtcatcctgagtcctagtcctgcagtgtgtttacacaattgtctcctgctcctaaggatcaactacaaaatgcaaaaatttccacaaatattcctacttagtatttcgggatgtcaaaagttctgagtttcttcagaaattttttctgaaataacttttcaactcagctcatcagaatgactaaccagagaatacgttcctctcttttgggacccttctgaggtcaaattttctcatgacttataaccccagtgagttgtttttttccccactttttcaccacttcatccccgagtagcattcttttgctctaatgcagatttctctgcacaaatctgctgataatctctgcttctctgtgggctctggctgctttttttttttttggcttatgattttaccaccttcattttttattaggtcatcagaaggcccattatcctgaaccttcccacacatgttaagtgtttatttgggaattatggcaatatctttctgatgtttaaatcacagattagtaaaaggaactaaattccagatggcactgctgtagcccatgggaatttgtgagagttagaatttactagcattaaggaaacactcaagaaagcactgatagactgttaaatatagttatgagaactttggtcaaatctagtaatgatctttagaaaagaacatactgataaaggcctgcttatttcttccttctgtcctatgcatacacaaacaccaaaatgcctctgaatgcagaaatctgctggcagttgcagcttgcaggtgctgaattaaacgctcccttcccatcccactcaacaatcaggcagtaatgttttatgaagtttaaagatgtgacctcagcctagaaaaactgtgaagactgcttaagaggaagaaagcatattggtatgcttctctttttctggcccagagtatgatttgctaatgcaggctgctaaagggatgtggttatacagaaagtagatttaggcttgcattcttgtaatcgaagccaccaaacatgtaaaatatcgaaaacacatgaacttaaaagaacgaagccaagccactcctactttcggaaggttgccacccttgagacataggtgaactttcagtttgatttatggcttgatagaatcccagtgaccacagtaatcagttggattctagttaaatttatagaaacatctctggtattattttttaagtcatcttaatttacttttcattctagagcctttttctcagtgtgcttcagagttcaaaaaaaatttttacattggttctctgcctcccttcattcctacttccatccctccttctcccgttccctctctccctcattcattcatgcactccacaatgagttagcatctaccctgtcccaggcaaggttctaggccctggcactacagagatgatcaagtcatagtccctgttcttagggacttacagttagtgggggaggagacttttaagcacaccacctacctttcaaatcaataagggctgtattagaaacagggatggtgccgaggaaacaacacagtcagagagcccagctcttcctgaggaggaaggttgggagctgggtgggaaggtgggtcatatctgccatttcagctgggtttttttgtttgtttgtttttaagatggagtctcgctctgtcttccaggctggagtgcaatggcgtgatcttggctcactgcaacctccacctcctgggttcaagcgattctcctacttcagcctcccgagtagctgggattacaggcgcgtgccaccacacccagctcatttttgtatttttagtagagatggggtttcgccattttggccaggctggtctcaaacccgtgacctcaggtgatccgccctcctcggcctcccagagtgctgggattatgggtgtgagccactgggcccagcctttagctgggttctgagtgtgactttactccaggaagaagatgaagggcactccagataaaggcagttatgcaaaagcacagagctgtgaaagggcagaagttcagcgtggctgggacaatggctggaggggaaagagaaaggggtcaggctgcaagtgcaaaggtcagcttttagaaggcagactctgctccctctgcctggtacatgctcatcccagatctctgcatggctccttcacaccactcaggcctggttaccaacaccaccaccccatagttcttgcccacatgccccacccccaaatttataatccctagctctagcctacctctgtgccctccaacactttctctttccttcctggtacttatcccaacaggaacccactattaatttatttatctgcctgtttattgggtgacatttttctaacacacactttaggacccacagatgcataaaaaaagaatgtctacactttaagtacttttgtttttaacatgggaagactgtatttaaatacatctgagttgtcagtccattaaaacaataataggcctttactgcttttttttcaagtgaacacaggaattcccgactttcttttaccacaaaagtatacgaacctagcattaggcagcaacatggtgttgatgaaaacaccttttttggtacagcatgcagaatggtaaggatggggcatgaatctctcttggccttgccaagttataaattatagaaagggaaattctgtggcagcaagggaacatcaccacagatagtatttttttttttccggaatctaaaaggaccagaaagcattttgataatcttgttaaaatactttaaaaaggcatggtattaaattgatggactctaaattacctgaaaattaattattcttgggtcaggtgaaaaagtatccactgaatgcttattcactctccacaaatattccatcatgtctcattcaggcatttgtactaggtctgagtgaaatacaaagatgaatcagacctcaggtagcttatcatcataaataatgctaaggcctgtctgaaagccccaaataccacaagacaggcaaagaggatgcacttgagggtagatggtgcttcagcacaaggagaacagcagcgtcaggcagggctttgaagtaaagggagaacgcagccctgctgaagtgacgagcgcatttcaggtagatgcgggaaactgaaaggtgctagtgagaagcagcaagttcagtttggtggaagaggagtactagaaaatccgaggctgggtgcagtggctcacgcctgtaatccagcactttgggaggctgacacagagaatcgcttgagtccaggagttcaacaccagtctgggcagcatgatgaaaccccatctctactaaaaatacaaaaattacctgggcctggtggcgggcgcctgtaatcccagctattcaggaggctaaggcaggagaatcacttgaacctgggaggcagacgttgcagtgagccaagattgtgccactgctccccagcctgggagacagagcaagactcgataaaaaaaaaaaagaaaagaaaatcccaggctgggtgcagtggctcacacctgtaatccagcactttgggaagctgacatgggggaactgcttgaccccaggaattcaacaccagcctgggcaacatggtgaaaccctgtttctactgaaaatacaagaaatttgccagatgtggtggcacatgtctatagtcctagctactcggaaggctgaggcgggtggaacacttgagctggggaggtcgaggcctgcagcaagtgatgatggcatgcaccactgcactccagcctgggcaacagagagagaccgctctcaaaaaaaaaaaagaaagaaagaaaagaaaatcctgtttgaaggtggattatagggctcccccaccctatgcttaatctgcagaaaagggagattgatcaaaggttttgcatgggcacagtaagatgtccagaagaatgcttcgggaagaacaggacacccacatgctggactagagaggagcaaatctgcagaggatgcctcaatggaggtcctcggcagcctagggaagaatgatgtcagtgcagatggaacagaggaaacggggctgaggcacgttcctggggtccactgacaagatctcgatgcttcagatgttggggaaaccattattctattcacgcagttgcccattccagaaatatgaggttgtcgtctcctcctcaatccactgaatcatgaagtcccatcaattctacttcctgctgagtccatttactcctctctatctatatggcccatctggtctcctaacgcatgcaactccactccattcgcaacacaaaattcatgttgatctttttaaaaatgctaagctgataatggcattctcttacatgaaaaaaaaacctttaatggctcagaaagaggctgaaaacccttcactttagtctctaatgccctgcttagctgtgttcctgcctccctctccagccgcatccagctcctctctgctccctggcttcctcctagatcctcatgcacaactcagctcttccctgtttccgccaccccaagaaatgctcctcactcttcacctaggccctcagacacagggtctcctctcccagccctctaaacttccctttgagcacataatttgtaattcaatagctggaaagcagccatggtgcagtggctcatgcctgtagtcctagcactttgggaggcccaggcaggaggaccgcctgagcccaggagttcaagatcagcctgggcaacatagtgagactccgactcttcaaaaaatataataaaatgaaataattagctgggcatggtggcacacgcctgtggtcacagctaagagcctgggaggtcaaggctgcagtgagccatgatcttgctaccacactccagcctgggtgacagagcaagactctgtctccaaaaaaaaaaaaaaaaaaaagttaaagttgaaaagctactttttaatgacaatttccctagacaagtgccctctgctccaggctaaccgtaaccatacaggctagaatagtatcttgtatacagaaggcactcattagatgaacagatgaataagaagcaaggagtcaaagatgacactgaggtttctagtcagggtgactagagagaaaacactatcactggtaagcaaaggggtgtaagttaaaaggaaaaaattatgacattaaaattggaagttgaaaaatatgttcagcagattgatggaaaagtagaaatggagctaaggagagaagaatgggctagaaatatgtacttgaaagtcactgtcacactttgggaggccaaaatgggcagatcgcttgagcccaggagttcaagacgagcctaggcaacatggcaaaaccccgcctctacagaaaaaaaaaaaacactacaaaaataagccaggcatggtggtgcatgcctgtagtcctagctactggagagactgaggtgagaggatcacttaagcctggtaggcagacgttgcagtgagctgagatggtacctctgcactccaaactgcatgacagagccagacctgtctcaaaaaaacaaaatgcaggtcactttcattgagctgggcatggatgctatacagctaagtcagagtgcaatgaaatgatctctctgaatatgtctttccaactagactagaagctccttaagggtattgcctttttgttgctgttgttgttgagacagtctctctcactgtcgcccaggctggagtgcagtggcgcaatctcggctcactgcaacctccgcctccctgcaacctccgcctcccggaagggtattgcctgtgttgtactcatctctttatcataagtgtcctaaataatgaaagaacaattcttcaagagaaaaggagtggtcagcccctttaccctcctgtcaaggaaaattaagcctgaaggtcatactattggatgcttaaaggccctgccgattcatcacaagacagtttccacaaactgatgggagagagacacttgcaaggcttaggtgagtaacatgagtcactttttctagattatcagagcattgtcagcactgaggggctgatggcccggtgcatgtggataaggtctccttttcctcttccatctcattaggaagactgaccccaagactccaagagacactttctcaagtgtgcataggctttctcttcagaaccacacgaagctcagaagcaaagctcattttggctttccagtatctctatggttttccagcaaatcaaggtgaacacccgagaaaactcaggtttcagtgctgcagtagaaatcgataggaagactttggcctgctttggttctagaccattcaagtcatctagcccagggaaggtgtcgtagggttccagcctggctcaccagagttttatgctgggacgtggggcaagagccacgtgcaataatcaagagatgctttgccttggtttattttctgactacatacctacctctaggacttttcaagaaaataagttccagggaaagattgtggtattccttagcaacccagccaaatacaactataacagcatctcagtttcaacacagtttacaggaagtaagagagtcagggctgggtctttggagaaataagctcaagggagatgtttctgtgttgggaagcaagaatttatgagctgtctgtctagtcagatagcatcacagatttgtaaataatgttcataataattagcaagattcctttctattactgtgtttaccaattggaaatatgagaagatcaacagacattaatcagagaactcattttatagatttatttatttattttttattttttttttttttttttgagacggagtttcgctcttgctgcccaggctggagtgcagtagcgcaatcttggctcactgcaacctccacctcctggttcaagcgattctcctacctcagcctcacaagtagctgggattacaggcatgcgccaccacacccagctattttttgtttttagtagagatggggtttcaccttgttggtcaggctggtctggaactcctgatctcagatgatccacctgcctcggcctcccaaaatgctggattccaggcatgagccactgtgcccagcctcattttatagatcttagaggcttcttttcataactgaaatatctgaatatattttagggaacacaaaaataaaaccatttaaagtggcaaagtggtaataggagagttatataaaagtattagaactaaatagcctttctgtaaataattaaaacttattttaataccagcacccaatgcacaacttttgctaaaatattgagagtacattaggcactttggtaatttaggaacaaatgctattttgattttactttctcttagatacactgcagatcaatgtcatcatgtcatactaaaatttaaggttcaacaatcttcatgccttttaaaagtaatcttctttgccctgcaaatttgttcttatataatattttagagcactaaaaaaaattacataacaaagccttgcagtttttcatttttattattttgactaatttttatcctttaagatgttcccatgatagaatttttagtctcataactttacatatgatgaaaactgaacgaaaatgacaacagtctctgaatttacactgcatttatacctctcaagagacattcttccaggacttcaaattcataaatatatctttcgtttcccatttttttaaaaaagccatgggccttgcccaccccctcaaccactttcaagtggcatgccaaatcatttttgcagtgtgggcagtcaatccagatctagattcttagacttcagaagcaaatcctctttacccctcctttacctatggattagaaaaatcaataaaagagactagcaggaagcaaatgacaaattcataagtgaagactctgtttatactttaataatttacaaggaatcaattattaggtatcagtgtattctgccttgattaaaactgttagtctatccaagaaaataaaaatgtattttgagtttttgcacatcttacattcacagtaggaatcctgtttctgcctatgtttctatgagtcaaacctgtattaaatatagacttttggccaggcatggcggctcacgcctgtaatcccagccctttgggaggccgaggcaggcagatcacttgaggccagaagtttgcgaccagcctggccaacatggtgaagctctgtttctatcaaaaatacaaaaaagtagccaggtgtggtggcaggcacctgtaatccctactcaggaggctgaggcacaagaatcacttgaacctgggaggtgaaggttgcagtgagccaaga

SEQ ID NO: 1290 - DNA, 1547 bp, Homo sapiens
gttctcattgttcagctcccacttaagagtgagaacatgtgggccaggtgcggtggctcacgcctgtaatcccagcactttgggaggccaaggcgggcagatcacaaggtcaggagatggagaccaccctggctaacacggtgaaaccctgtctctactaaaaatataaaaaaaaaaatgagccgggcgtggtggcgggcgcctgtagtcctagctacttgggaggctgaggcaggagaatggtgagaacccggaaggcggaggttgcagtgagccgagattgtgccactgcactccagcctgggtgaaagagcgagactccatctcagaaaaaaaaaaaaaaaaagagtgggaacatgtggtatttggttttctgttcttgtgttagtttgctgaggataatggcctccagcttcatccatgtccctgcaaaaggacatgatcccattcctttttatggctgcatagtactccatggtgtatattaccacatttttaaaaagatctaaatttatattgaattataaatattttatataacatagatggcaacctacttatgactactgattgaattaatatggtttttactaaaagtatttaaggtatttattcatagaaaggcatttacttggatatcaaatttcttttctgattcaccttttatccttgagtaaggagaatgtgatgtgatatatacatatgcatacatgtatattaattaaccaacaactcttataagtctcagtttaaaggaccttcctataggaagccctgcctgacaccattattagatcaggtgtcttatcctatgcttctaaagaaactgttttcctcaattctggcatttacattttaatgcaatcacttacttgtctatatttctctgaagactaaatgaagaaagggcccttgttttcttgttcaccctgaagcctagaacagctccccatatgtataaaaggatgacactgaatgaatgagtgagcaaaaatcactcgaaggattatttagaaattacactgagtcgggatatagttaaatgttttgaaaactcaaaatggatgcatggggtattgaggtaatcctattttgttaaatctgatcacttcaaatacctcattccctacattatgggctgcatgtgatattctactttgcacttaaaattgataagctaattttaaaaataataagttgagcatttagtagataatttatagacattctgcaacatagatgggttcgttggaaagggagagggatgctgggctggaagactatgggtagttacgccttacatatgaaaatggtctttgttggaacaagggagaggatttctcagggcaagtgctccctagagcagccaagacgggaggcagaggtctcagaagagtgagctcctctgctggataaatttaaatgtctttagtctttattaagtacccattgacagctctgccttatggtcaagttacggaaagcacaagagaagacctcgtccgggctctcaacattctcagtagaggctttcagctctcaccctt

SEQ ID NO: 1291 - DNA, 1439 bp, Homo sapiens
tttcatcctttcgggactttaagaaggtataaacattaacccaggagggtgcacaattttgcaaggaacattacatgaacttcctcaaaacaagtttacaggataaattttattataatttgatgcatatatttacattcaagagtttcattactgtcttttagtctgtatctcatattgtaatgctagtcacaatctctgggaacaaatgcagaatatacttgaagatatgaataacgtagacttcaaaaattgtcagagctgattgttttaggtaactggttcatgtcctccagttccttcgacagatacattgatacatttttttaaatttttttattctgctctttctgtctttccatgttggcttactgtcaaagcatctgtcaccctgacactgatgtgtttttgagtgattataagcttattaaatatatatgtatacatacacaatacacacacatatgtgtgtatatgtgtgtgtgtgtgtgtgtgtgtgtgtgtgtgtatttgaaaaacgctttcaacatcttgtatttataattttggagaaaagaggacttacccagcagcaaagtatacataaagccagcagctctgttacaaagatagaaaatataccctgcaatcattataacttctgataaatataattctgatttttaaaaatggctctaaagctaaatgattatgaaggtggcacttctgtcagaataattcagatggcataatcaaggatgaagaaattatcatttcatagagaaaaaaagagtaatcatacatgtgcagaatttttcttacaggagtgatattttgttatagtatgaagacagaaatatgggaaaaaggtaccattggtcagtttactatgaaacaatattaaatgaaaaaatgtacaaaacactgaaattcccattgtagctttgattaattatttggtattccaattcagcaatagttgtgggagattataaacacatattagataggattaaaaagatgatgattttagttagaagactttattccagcaggaatatatttaaactatgttttatttatggggatttttttatgccatattagcttgaatgagccttgttctatgcagttcagcaaagaagagattagagaattggtcttgtatatttcattgactttctagaaagtgcatttccatcactgctagtgatttctcgagcctgtaagatcgtttcattaacttttttttgccatatctggagcagaaagaagcagctgaagataatgttctaaaggcaaaattttgttgtctttggaattctgttctttgtgattttataccttaaaaattcaatttactgtaacttacttgtaaattcactattgacctaaaatacatgtttgtgttcagttctctagcttaatccaaatatatgttaatctttgtcagactactc

SEQ ID NO: 1292 - DNA, 7471 bp, Homo sapiens
tatactatccatggtgaagaggacagcctaggtcgttgccctcatgggcttgcattccattgagacagatacatttctcagtgcttaatttagttaagtgagatgggggcgggaaagaagagaaaatagagagacagagaatcatggggttttgactttacgcgggagtcagggaaggcctccgtgaggatttgttagctgaaaggaaaccttggttgaagtgagggaggaggaaaccttgcagatatcttgggagaagagcacctgtacagaaagaacagcaagtgcacagccccctgtgctgggaataggcttgtgtctgagaaccacaaaaaaagccagtgtggctggaaagggcaggtaagggagagcataaggggaaatgggcacagagctagccacagccaactcagggaggcgttgtaggccctggtaaggatttaggactttcttttgacttctgtgataagaaaccagtgaagggttgggcttggggaagttgcccctggctgtgtggccgcagtggaaataagggaagcaggtaggatcctgccgtgacccgagagagatgtatggctgcgacagagccacaacagttgggaactggtgggtgatgacatttggggtctgttttgagaattcaggggatttatcatctcgttggtggcaggaacaaaactcatagcagcatagtgcaagaatacagacagcatcctgttaaggaccgcagtgttttctgcaacttcttccatgtgtctactgcaaattgtctgagaagggcagggcctaggaaacatggtggaagttttgagataaaaatattgcagcccatctgcatttccctgggagctcaattagtcatcactttgccttattatttactaagcgttcatcatagttctaaatagattcctcaaaagaattaaattcaaagggcaaaggggtagaaaatggatctgactgtctctgcactgggagtccctgggagggggggacgaggaggaacagaccaaacaaagcatggctgatagaaagggaagcctgcgatgggtgggttgagtcaggtaagacagagaagcttgctaaggtggagtggaaggaaatcctatcattactgtggctgccctctgaggtaggaaggaatgaagagcccgggaggtttaaagtgctctgaagcactgatactgtaaatgtggcatgctagcataggggaaagtgtaattcagacaggcagactactctgtctgcattcctacaactgcttctcctccccaggatgtgcacgtgtgtgtgtctctgtgtgtgtgtgggcatgtgtctctgtgtgtgtctgtgtatgtctatgtgtatatctgtgtgtatacaagtgtgtgtctgtgtatgtgtccatgtgtgtgtctatgcatatgtgtctatgtatgtttgtgtgtgtgtgtgtgtctgtctgggtctatgtgtatgtctatgtctatgtatgtttgtgtgtgtctgtgtgtctatgtgtatgactgtttctatgtatgtctctgtgtgtctctgtgtgtgtctgtgtgtctatgtgcatgactgtgtgtgtctgcatacactcaaaatgcttctgtggaataaagtcaattagattttgcctttccacatggcttctgtatgacctgtgcttgaccaaccatcaaccaaagcccacggcttttcctctgaaagggatgccacatttttgtgtgtgtctgtttgtaaacagtgacattcaagcacaagggttagggatggagtggataaggagggtgtgaaacagcacaaatcagagaaaatttaagaggtacaagaagaaggttttttgccttggctttaaaatgctggtaaacactaactaattctatgaggccagcatcatcctgataccaaaacctggcagagatacaacaaaaaaagaaaacttcatgccaatatccttaatgaaacaccaatgcaaaaatcctcaacaaaatactggcaaaccaaatccagcagcacatcaaaaagcttattcaccatgattcagtaggcttcatcctcaggatgcaaggttggttcaacatatacaaatcaataaatgtgattcatcacataaacagaactaaagacaaaaaaaccacatgattatctcaatagatgcagaaaaggccttcaataaaattcaacatcgcttcatgttagaaactcttaataaactaggtattgaaggaacataactcaaaataataagcaccatatatgacaaacccacagccaatatcatactgaatgggaaaagctggaagcattcacctgaaaaccagcacaagacaaggatgtcctctctcaccactcctattcaacacagtattggaagttctggtcagggcaatcaggcaagagaaagaaataaagggtatccaaacaggaagaggaagtcaaatatctttgtttgcagatgacatgatcccatatctagaaaactccattgtctcagcccaaaaacttcttaagctgataagcaacttcagcaaagtctcaggatacacaatcaatgtacaaaaattattagcattcctttacatcaacaacaggcaagctgagagccaaatcatgaatgaactaccattcacaatggccacaaaaaaataaaatacctaggaatacagctaacaagggaagtgaaggacctcttcaaggagaactacaaaccactgctcagagaaatcagagatgacaccaaaaaatggaagaacattccatgctcatggataggaaggatcaatatcatggaagtggccatactgctcagagggatttatagattcaatgctatttccattaaactgccatcgacaatcttcacagaattagaaaaatctatgttaaaattcatgtggaaccaaaaaagagcccaaatagccgaggcaatcctaagcaaaaagaacaaagctggaggcatcaccctacccaacttcaaacaaaactacagtaacaaaaatagcatggtactggtgcaagaacagacacataaaccaatggaacagaatagagaagccagaactaagaccacacacctataatcatctgatcttcaacaaacctgacaaaaacaaacaatggggaaaggattccctatttaataaatggtgctgggagaacaggctagccatacgcagaaaattgaaactggagtccttccttacatcttatagaaaaatcaactcaagatggattaaagacttaagtgtaaaacccaaaactataaaaatcctagaagaaagtctaggcaataccatttagaacataggcatgggcaaagatttcatgacgaaaacaccaaaatcaattgcaacaaatgcaaaaattggcaaatggaatctaatcaaactaaagagcttctgaacaacaaaaaaaactgtcatcagaatgaacagacaacctacagaatgggagaaaatgtttgcaatctatccatctgacaaaggtctaatatccagcatctattaatacaaggaacttaaacaaatttaccaaaaaaaacaaacaaccccattaaaaagtgggcaaaggacatgaacagacactttttttaaaaaagatatatatgcagccaacaaacatatgaaaaaaaagctcaacatcactgatcattagaaaaatgcaaaccgaaaccacattgagatgccatctcatgccagtcaggatagctattattaaaaagtcaaaaagcaacagatgctggcaatgttgtggagaaaaaggaacactcttacactcttggtgggagtgtgaattagttcaacctttgtggaagacagtgtggtgattgctcaaagacctaggagcagaaataccattcgacccaacaatctcattactgggtgtatacccaaagaaatgtaaaccattctgttataaagatacatgcatgtgtatgttcattgcaacactatccacaaaagcaaagacatggaatcaacctaaatgcccatcaatgatagactggataaagaaaatgtggtatatatacaccgtggaatactatgcagccataaaaaggaatgagataaagtcctttgcagagacatgatggagctggaagccattatcctcagcaaactaatgcaggaacaaaaatcaaacaccgcatgttctcacttataagtgggagctgaatgatgagaacacatggacacatggcagcgaaacaacacacactggggcctgttagggggtgggagggtgcagggagggagagcgtcaggaagaatagctaatagatgctgggcttaatatctaggtgatggggttgatctgtacagcaaaccaccatggcatacacttacctatgtaacaaacctgcatatcctgcacatgtacccacaaatttaaaataaaaaaatatataatatatatataaaagaaaatgtggatacacagagacaccagacataggcactcacacagaaaaggccatgtgaggacatagagaaaaggcagccacctacaaacccagaagaaaggcctcagaagaaaccaaatcaactgatgccttcatcttggatttctagcctccagcctgagaaattaaagttctgttgtttaagcaaaaaaaaaaaaaaaggccggtaaacactggtgattctgctttatactaaaaatgatggcggtgatgggggaaccgtttactaggtacaaccacaagatatttggtcaaaaaggattgaaagccactacttgctttcatttcttgaaatacatttctttaaatacataccatttcttgaaatacatttattaagcacagatgagtgttgttttggtttttgtttagtgattaagtgtacaatccccaataaaatattttgaagtttttccaaagaaaagaaactctgcctggctgcatcagctagacaaaggtacctgcgctgctgtttgtttgtttgtttgtttgtttgtttttccctgtatctgctggaatattttagctgatggacatttgagctggcattacttaaatgagaatctcttcaaagtgatgcacgctgtgtttttccctgtgagacgtgtgaatgccttgtggatatttgtgagtacacttaagtgtttttgttttccactatgctaggtcagttttcagatcttattaaaaagctcagggtttcgggaatccgactgttctgcaaatgcctgctgctgttgttaagtggcctgtaccatccttgagtaggcaagaagagctgagatttcaccagaaacagtgacattcacacccaggggctgaaataaggcggaatgcccacctggagataagtcttggctgtcacacctggaccgcctgctctggtcatgtgtgtgtgtgatctataatagggtcacagctttatgaaattcagtcactttgtagcagccactctaaggaggatgattcatggtccctgtgcaggcactgcacccagcaccttctcaggaacattcacattatttccagctggattgaggctggaagctccctggcaagcaatagaaaagcaccaggtgttcccagcagcgctctctttcacccttgcaagctgcaactggcaagagaattgtacttgatggcacacggtgtgatggttgcctcactgccagagcatttgttctggatgcctctgtccccaggtgtctcagaagtaatcctaatcattgaactttggccctctggaaacaaggccagtcgcaagacacgtcaggaagcaatttgtgcatcgagactcgagctgctttggagtttccctctggattttagtcaagctgtcacaaagttcatgacttggtttttccactcttgtaaaatgaaggctgctctgactcctgcctgcaatctccagcttattgcctttaatacttccctgttgctattgctaaaccccttaccttatacagactgtggagatgggcaaaggaaaaaaatctccaagctttttgatatggtgctttgaagacacagtttactaatggcctgaaagaattcattgcagcttcccacatgcaaagtttattttcggagagtagtttatatatggaataaatggaatagaattgagtccagaaataaactctcacatttttagaaaattggttgtcaacaaggatgccaagacaattcaatggggaaagaaatgtcttatcagcaaacagtgctagggcaactagatatctatgtgaagaagaataaagtgagaactctaccttacatcatattaaaaaattaactcaagattgatcaaagacctagatgtaagagctaaaactataacaggcttagaagaaaacataggtgtaaattttcatgaccttgaattaggcaattatttctttaaaatatgacactaaaagcacgaaaaacaaaagaaacaataataatttggacatcatcaaactaaaaatgttgtggctcaaaggacaccatctataaagtgaaaagactacccagagaatgggaggaaagttttgtaatgttgtatctgaaaagggaagtatctatatagagaacaattacaatgcaataataaaaagacaaatactccaatgttcaaatgggcaaaggatttgaaaagacatttctccaaagaagatattcagatatctaataaacacatgaaaagatgctcagcatcattaaccatcagggaaatacaaatcaaaaccacaagagaccactttatacccatgggaatgtctataatcagaaagacaggtaataacaagtgtttgcaaggatttggagaaattgatggtggaaatttaaaatgatatagtcactttagaaaacactctggcagttcctcaaacaatcaatcatagagttaccatatgaacagcaattctacttctaggtatatacccaaaaaaatgaaaacatatattcaccagaaacttgtttatgaagtgcagagcagcattattcttaacagcctaaaagtggaaacaacccaaatgttcatcaaactgatgaattcgtaaataaaatatactatatccactcaatagaatattatttgccaattaaaaaaaataaaggctggatactgtggctcacacctgtaatcttggcactttgggagactgaggtgggaggatcactcgaggcctggagttcaagaccagcctgagcaacatagcaagactccatctctacaaaaagtaaaaaattagccaagcatggtggtgcacgcctgtagtcctagtgacttgggaggctgaggttggaggactgcttaagcccaggagttcaaggctgcagtgagcaatgatcatgccaccacactcccgcctaggttgcagagcaagaccttgtctctacaaataaacaaaaactaaatgaagtattgatacatgccacaacatggacgactcttaaaaacatcatgctagccgggcactgtggctcacgcctgtaatcccagcactttgggaggccgaggtgggtggatca

SEQ ID NO: 1293 - DNA, 1961 bp, Homo sapiens
cttgcactctcccattgtgcttacatttcatgtgtgtggcatgtggatttcatttctctttctgtcaaacatacaagtattccatggattcctatggacccaactgcagtttgaattttagaaactgtaacatttttggccgagcgcggtgcctcatgcctgtaatcccagcgctttcagaagccgaggcaggtgaatcacttgaggccaggagttcgagaccagcctggccaacagggtgaaatcctgtctgtaataaaaatacaaaaattagccaggcatgatgctgtgtgcctgtaatcctagctgttcaggaggctgaggaatgagaatcactggaggctgagaagcagaggtagcaatgaaccaagattgtgctcctgcactccagcctgggcaacagagcaagacctcgtctcaaaaaaaaggaaactgtaacattctgtggtaatgagatacccagtttatggctgctttttgcctattatttgtgtactgaccacagaagcttaaagggtactgtggcattaaaagtgaatctctttgttcctcatatgtatatttttttcatatttgttaatttgaaatttgaaaatattcatcttttggtctatggcattgatagcattcaccagtgtcacctgaaatttgagttcctgctcaaactggaagtcttgtatttttttcctgaagcactcttcaaggatccaactatggtagcttaatcattacatctagaaaatgacttatggctccttgtgaaaattgcttctttgtatgaaaattctggtacagcatgcaggctattgtgttctgggaatagcatagtgatgatgtgcgttatggagataacaggacattaggtatacagaatggaattaatatttagaagtgcaggatgccactcagataaccctgtggtcatccctaagtattgtgtagccctcggttaacatatggcacatggacagggaggagccttgggaatcattaggttcagtgccctcattctatactttgaggaaactttgacttagagaagttgttcaggatcatttgctcatgtcactcaactacttagagtgataaagccaaggggaatgccagagtttcataactttcagtccagggaaccttcgacttcaacatactttttcttctgtaacgtagcaaatcaggggtttcaaaatattatgaatgttaagaaaaaattggtagattttcttatagttttaagagataactgaaagagcatcctttataataataaatatgacagcattggttctacagcacttactataatcgtattttcatcccaatagtctagtctatactctttattaattatccactatatacataacagatagattatttttattaattatccactatgcacataacagatagacccagatggacttgtaaatgatctatggctatatttatttttctgtaggtagcattacacatggaattgtttcaagtgggaacaggggaagagaagaaagccaaaggttcagatttggcatagctcttggagaagatgggcttgaataatgagaagcacgcaggatgtcatttgagagttgtggatggaaagagccttctgttcaggaggattgcaatgaggggaaatagaattctgagatcggttctgtgtatttcctcccctagaatggaggaaaggagactgggagcagaagagatgatggtaattagaaaacagatgtgtgtggctcagatggtttgatgggcaaaggccagtgagaatcactgccgagttctgggaggctttggcgatgatctcaaaatgggaagcttgaaatgattaaaactgtggaaaggaagagaaagataaaaggaagataaaggtagatttattatgggacaagcccaaacaagaataggacagccaaggtgtccaaaataaaactgggaacgcctatggagttgga

SEQ ID NO: 1294 - DNA, 2410 bp, Homo sapiens
accttttctatgctatcaagggacactcttaagattccattgtagacataatccttatcagtttgaatagtgttgaccatgtaggagaatttgcctgtccgagttcaaaatcttagttcaaagatgaatatactatctttagtcacagatttgtgctaacatactacgaactaaaatgctgcaatcctttgaaagttgttttataggcactgctctttcacttaatgtacttctttcttctcacaagacagagcttaaaggcttgtcatgaatagcatgaaatctcaacttcccacgcctcagtgtggaagccctatcataaaaacatagtacattacccttaaaacaaatttctctctgacttcagtgacactgaaatggactgcaaacaatggtactggcagagttccagggtttctgaacactgcttcttaacataaagtgagttcacaaaggctggggttgcatttctgaggataacggatcctttaaatactgcacacttttgtgtctacacatacaaagtaatgcagtgaattggggcaattatccttgtaattcaagtgcgccctttcctccccacatacatattttggtttcaattatctgagcatttcaaacaaaagctatctttttcccccttggataattgcttcatttctctgctttttcttgtgtatgtaaattcaaattattcccaaatctgtacgtataggtcagagaaacttttgcaaataaatccttttggaaccaacacttctctgttttctaatggagggccatatagcacctcacatatcaacaagcaaaagggcagagtcctatccaggcagggacatcctgttcccccatcttgcagcctgtggatcagggatgatggcagaggccttccccccttggggacttgacagaagctgtcatccagtaggcaggcacacaattcacctgtggcttgttcattatcatcagacgtgttgacaggcatggggcctggaaaggaggcacagcagtctttccatgccagctggtgaaaggatgagaggctccatctcacagcaggagtgagtcatggtgccagcgtcatagacaggcataagtattccaagtcatggacagaaagtccctcaatgcctgtggactcttttgcagggcctccttgtgtggggagggacttgcagaatgggattagaaattgtagactggtctgtagtgttggactgaaatatgatgtgattagctggtgacccgaagtcccagaggaatcaggcatcttaatgagctcacatcagtttaaggaaaacagtctatggttttgtaggtaagcagtgcagtccatatttttgttgtcgtttgtccttctcactaagccatgaaaggaatgtgtggctttctttcaaaatgtgtatagctgggcatgccagctcacacctgtgatcccagcatttttgggaggccatggctggagaatcacttgagaccaggagtttgagaccagcctggacaacatggcgagacctgtccctacacatacacaaacattagccaggcttgctggggcacacttatagtcctagcaactagtgaggctgaggtgcgaggattgtttgagcccaggagttcaaggttacagtgagctatgatcatgccactgcactccagcctgggtaatagagcaagaccctgccttaaaaacaaacaaacaaaaatgtgtagacatacatatgcacttcatctcaggaatccttcgttgactacaactgagtaaaaggaatgtatgtttaagatacaataaagtccattctcggaacacttactgaatctctgaaaatcatggatttttcatgttgtgaaacataggtcaggggagggcacccctaaaagacctcacataaccatagggaaaaactgtatggtttttattgcactgtggttatagtttcaaggttttagactgcaagactctaaaatgtgattacttcccttagcattgagcaggagagcttgttgattccaaatcaacacagagtgagtgtgcgtgggtatattctgctcggaagtcaattccttcattcatcagctgataatgaaaacaaaatactttgtttctggaaggggggggatctatggagccatatatccaagagatgtcaagaggccccagttcattaaaactatgaggaatgaggtgccagaatgaggctggaaccatttaagattagtggctgggatcaaaggtctgtgatgaagtcttgggaattgtcagcagctgatgtaggcacaaggatgaaagaaagattatttcatgatgctaaggttttcattttctggttataaatcagtatttgtttatgtcagtttaccttaatgggaacatttagtcacataagatattttaatataatttattact

SEQ ID NO: 1295 - DNA, 3154 bp, Homo sapiens
gcctcagagccccttcaatgagggtaggctggtcccccctgacaaaggtcccagttacatcactaatggttaactgacgtatctcctgaaagtcggccgtgactcctggttgccaaaatatttgcctgtgggtgaaaatgcttggcaccactgatgaccctcactttaaacttccaaccctggaatccctggttcttctgcctgttctgctgctcctctgactctcctttgtggcttcctcttcttctttctaggccctacatgtgagaatctctgtgtttctgttctggtgccttttctctttccatttcctaaatacctgtatctcctctaggtagaaattccaaacttccctctccaatcccaactttttctctgagcatcatccctccttttccattagctaaacatcaaacccctgggtgcactatcaccatctctaaaccatcccatatcattttacttctgttttcctatcagtgaggctgccatcttcccaatcagatgtgaaacatcagacatccttgactccacctctctcttctcttcctacatctaaacagtcacagaatattagccatttgtttgtaccatgtcttacctacctttctattgctagaaacccagccctagctcaaatcatgaagcaccggttctctccagaggaaccatagcaggcttccacttctattctatcccccaaccatcccccaaccagcctattctcagcataggttctgttttggtgtgcgtagttccattattcaaaaacccaccatgactcctccttgcctgcacaacacagtccaagcttcagaatttagtattcttgccgtttattatcagttcatcaaccgacatttttcatgacccatttttgcatcctttacataatggatattccaaccaaactccaccattcccagaatctaacccacagtttccacctctacatctttatttacagcattccctttatctttcataccttcctcctctccacctgttccctttatccataaatattattgaatatctcccttgtgtaaggtcttatgaacatcagggcattgttcttcccctgggttgctcagaatccagcctgttgaaatcctatgaatcctgcaaggtttagtctaggtaccaccaccttcttggactcctctttgatctcggtcagaggtgactgctgaccattgcactcttgcccttgctcgtgatgttttctcaatgctagatgccagtccttcatcctcgaaggtttttgtgacagctgttccttctggctagcatgcccttactccgtgtagccaaattcttacttcctttagtctttcctcaaattcacatcttcaaaggccttcccccaccaccctatctaaaatatcctccaacccttcccctgattcacttttcttccttgatgttatcagcacacatacagaagtgtgtgtgtgtgtgtgtgtgtgtgtgtgtgtgtgtgtgtgtgtagtttgttatttgtgtgttgtaggtcttccccaccaggctataagctccatgagaacagggatgctatatccgagaactgccctttggcaacaccagtcacctttccctcatcctccctcttaatttcacaaagaacacacaactccaaaattatagtttatacattctttggaccagatcaaattcctagacagggctttctttccccaataattatttccacaagcagaaagggagagagaaatgcatttatcctctcctgtccagctcattgcttttgattctggttacatcgaaaacaaccactgccctctccccaagcttagcagactctcaaataagaacttcatcaatgtctcttgaatgaattccccctacccaagaaacaacctcttacgtatcttttccacagcttaatatcctccccacagcctgaagtactgatggtgcagaccactgaccacagttttctcttttagggcagctgccttcagcagggactaccacagttccttcttgcagaacagccgcggggcccaggagctgcaaaagcagagaacactaaaagcagaaacaaaggtgctcagccccacttgtgcctggctttaagacagagcaccccttggtgtcccattagctccagaaagaaaaatcactggaagtgggtctttcctcctgatgccctggactcccaagacactttctcctttcatttttcatctcgctgggagtcagtatttttgtaaccatcgctgactggatataagggctctgtgggggagacccagtcatcctaagtggcagagacagcttgttcctccacaatgtatctttctgagactgcacattggtagcaaaggttgttttgttcattactttttcctggtatgattgtgagcaccctgtggaaaagcaagccttggcttttcttctgcgatggcgtggtcccccactgcaagatcagacacagaaaggcctctctttgagaggaagaagcacccacaccctgacagtactaggacacccagagcaaaccctgtaaagaccatgggctctgcaaacaaagctctccaggaaacagccaagccaggacaattccctttggtgacctgcagtgttgatcatttccaacacctttatctgtggtccatcgagggttctgagtcatttattattggcacctgtgacacaggggtcctcatggtacacacgtctgagcctttattgcgtgtcttctgatcagccagataggtacctcgcacatctctaatatgagctctgtgtctaggacttaattatctagcctagattcatgtaattcgccatagaatctggcaaactgaaaattgtcagtctaaagacattctgtgcagctcctctgatggccacctgaaggtaataacagcctgtcacctttagacaagccgcttgatttctctgggcctgggctccctcactaatcaaatgagagggctagaagtagttggtggctctgaccctggctgcgtattagaatcacctggggaacttgtaaactaactatggtgcctgggcccctccttcccagactaattaagtgagaatctgggggaggaggtggaggccaaagccccagtattttttaaaagttccctagggaatcctaatgtgaagccaacattgg

SEQ ID NO: 1296 - DNA, 5683 bp, Homo sapiens
gctaatttttgtgtgtgtgtgtgtgtgtgtatttttagtaaagacagagttttgccatgttggccagcttgtcccaaactcctgacctcaagtgatctgcctacctcagcctctcaaagtgctgggattacaggcatgagccactgcgcctggcctaaactgattttcattctactagaattaatgttctcatataaagaattaagtagtcagctatatggaaaagtgaagctttcaaaaataacccattccctattgatctagccagcttcagatttataatagcaaacaggataccaaattataacgagaccacaaattcttatctgcagaatcctcatgtccatggagaggtaaacttaagtctcttcaaaatctgtaaatactattagctaattattctgaaactggttgctgatacattttaaggtttctcttaaagttaactcactttctaagattctaccactactggtgggggaaaaaaaagcagtttttttgttaacgtataatgtttccattaagtggaaattcaagggcaggcagatgctatctcttaagagttgagcattttgtattaaaattaaccagcatgatatttggcatctcactgggatgcaaaagggaacattatttgctgctgcgtgccattagtgccagaaacattttttcataaaatgaagagtgcagctccactaatctattagtcctaagccattttagatcataccattgattaactaaaatatttttttttcaaatgacggctgatgacagagcactaccttaaaagtcaaagaactataaattaaacatgaatccagttaccatgttctgtcaaaacaagaaatacatgcgtgtgtttgtgtcctttatatgggccaacataagcttttcctattatttctggaaatattcagatttattagcacacataaaatcctcagactgaaattattataacatttatttcaaactgaaaaaaataccaaaggagtaatctggggggcttggtgtctcatggtggactcctatttgcttttgccccttttcttctttgggtcttaccttccagcatgcttaaacttctagttatagaaacccatggcaacactcactgcccagaataactatgtttactcagataatgaaaagtggtgtgataaccttatctcctgggataattaggttatgtccaaaaagccaggctccttaaagatccttttcaatgatctccatgcttgatacagggcactgactttactacaaaaatatttaaaacactgtggcttttcatactttcacaactttttattttatgttcagctgctactcaaaaaactaactttgtgcagtattccaaccaatacatcatcacataaatacatcttttacacaagcaagtgcacttgaagaaattccagttgaaggcatacaagaacctccaaggttacccaggaaacctattctgacgagttatgtatatgtcaaaacacatgagtctacatcttcataaaactgtgtgactgagagtgcatcaggggttaagctacgtaaacaaacaaaaccagcaataatggcaacagaaatattcacaatattggaatcaaaagtaactatttgtgacatctaatgttgattggttatccataattttttaaagccttcatattaaaaacaacgaaagaaaaatacatgaaccaagtatactatgtaaaatggataaatgaaagcagagaaaagaaagcaagcaagaataaatatctactccaaaacccaactctaaaatgagatgcataggctctttaaatcacaaaatctgtgtggcttactaatggaaggatccttagagatcatcttgtccaatctaccttccaacgtggaaatttattatccatcatacctaataccaaactgacgcagtccagcagaaacactccggcctgagggtatgcactgattccattgttggacagctagctctatttgttacagcccaacttttgacggatgtgtaagacttgaagacattaagacccagaaatgactctatgattatactatgattataatgactatatgattatacctcattataattactacagcctccataaatatatgctactcaaagtgtaaaaagtcacatcaccagaagacaaacataatgtgaacccctatcccaaggataatttatctgccatatgcacaaaacccagtctcacgatattcgagtctgggtcctctctgagaaacagacatcaagatctgatgacatgtgcaagaaatttattgggtgagacacctgtgaaggaagcggggatggattctttggggagttgcgattgttttgtgtcttatgtgtggtggaggtaaaagaagttatgcctatgtaaaaacacatagaactgtgcaccaaaaaagttaatttaactatatgcaaatttttaaaattagaaaatatatatttaaaaatttggagggaggtgtaggaagctgagaagcatcagactgggatacagattcaactctgtgaaggaggcagtggcggcagtgggggcggggaaggaaggaaagaagggacgtagggaaggagggagagagggagagagggagacggggaaaggaaagaagattttaaatatgtgataacacatgatgttccaaaaggtgaagaaaaacaagccatctcacagattgctggaggcagtctacaatggtaaggctaccaagaaggacaagttggacagctctatcaaaattagaaaggcacaagccctctgatccagcaattctacttttaggtatttacatgacagaaatatgtagacatatgtaagatgatgtgtctataaaactactaattgcaagattgcttataacagctaaagctgaaaaaattcagctcagtgtcaataataggggacaagttaagttaaataccttgtgttccattcatttaagggaataccatacattcttgaaaaatactgatgctcatatgtactgatgtagagatatttccactgaatgaaacattgcaaaaatatgctatcatttgatcatctgtattaaaaagatatatatggttgtctatgcataaagtatgtctaaaaaagaagaaagcaacgatagcatcagatgcctcttaatataaaggaactggctgtttgggcaagagaagttggtgggaaatgtcccactgtaaatcctagtggaaaattttgaaatttgaatcatgtaaatatattacctgttttgaaaggtaagcagactctattttaatgaagatgaaaaagatcattctaaatgttaggtgaagaatacggttcattagggaataagtgtcaaggcaggaagacctcttcaggaatggtggtagcaaaacagggggtctccgtggggctgacagaccctgcatacatgctaaagatgcagccaacaggagttgatactgtaactagatataatggatcgggggaaggggactcaggctggactgacttttggcttgagtatccagataaacaatgttggcatctgttgagatgggtatgactgagttacaaacagcttagcaggtgtaagaagacaaaaacaagaattctgtttgggacacattaacgtagagatgtttgttagccttccgaatcaagagagtaacagtacatcggagtccataaacgtgcctactgagatcaacagtgcttttaatttgcggttcttcagctgcagtgagacggggcatgcttcttaggagtcctggtcattgtgatgtataacactgtgactatctgttcatcatgtttgctcatttgcctattgggcattttgttccttattatttgtaagtgctgttagcatattcaagaaaattggcccttttatcacttacattaaatggttttcttcagttcatcaattttacttttacattgtttatatcattttccctagaggaactctaaatttttatgtggtcatatttactagtttttctatggcctgtggcatatattcttttcataatcaggaaaaacaaagacaaatctcatcagtaattattaatgtgaatgtaaattctataacataaaaaatacattttatataatttcagaagttttgtagtacttacacaagtgttgagggcattcattcgtcacttttgtagttaacccactggaatatctttaataaagtaataggatttttctttattccttagaaaaattggatatttagggatattcttcaattcaaagctcatgatcaactaaggattctttagaggaatggtacgtattattttttacttacagcattaaaactcagctagagataacaattgtgtttgcatagcttatttttaaaacatgtgggcacagtgactttgtgcaattattttagaaaacaccaaagtagtatgagagacactgctattttttaaatgctactcagcacaactaatgacttataaaataggtaattatttcctttgaggtcagaagtagacttaaatgttacagcagaaagccaaaataaatgtgattggtttttctcaaaatagtaaattagcacttgactcccacctgcacactggtatttatcttcctctccacaactagtaactcaatttgatgcagtagcagggtactgggatgccacacgtggtttaactcaccaaggagacagctgctttgtactgacacccactacacttgtctttaccccaacaactgttcacattaatctgagttaactaccctttggagcaacctgttcaatctcagttagtcgcctactggagtgcacagacacaggtgattgagatttgagggaaccacagtcacactgacagaaatggaatctcacccactgcatcttcagtctggctggagaacctgaaggagctaaaggcttgttagaaaatcctaaagaaccataatcttctatcgcatatgcaaagcctgttttacgtcaaatgattgtcagtggctattaagttgcattcacacaaatcgctaacaaattaatatctgacattaagaggggtttatttcagtcttttgtttttcttaaattataaaatgaattgctcttttatttttgaaacgtgcatacactttaaaaatgaaagtgactcccctctccacccaaccccctcctaattccactctccaggggaaagtgctgttaatattttggtgtacaactttgcaggctcttaaagctgcattactactcatacatatgtatatgtacgtatgtatgaatatgtatgattgatatatatgatgcacatatcaatctagcctgctgtttaagcaaaaatggtatcatacaaaaagttctacaattccatttgtactcaataatgcacaaaactccttccgttaaaggaactacagttctaccacatttttttcttttggtgtcatggtgtaccacaccacgtgcatatcagaatttatgtaaacattctcccttggggggccattccagttgtctctgtttttcataattaacaataatgcatctgtgaatatgtaccaccatacacttgctcatctatttgtgagagaccgaatatgagaagtgaagtttctgggtcagagaacatgtccacttgcatttctgataggtattatcaaatgccttttcaaatggtggttgttttacttga

SEQ ID NO: 1297 - DNA, 5773 bp, Homo sapiens
tagtttgtaagtgaggcaaaataaaatcctagaccatatacaatctaaatagaaataaatcaaaatatgtaaaaaaataaagtcaatgttaatgagctaaactctctagttaaaagacaaagagtgccaaataggtttacaataaatttagttatagaaaaacatatataacaagatacataaaaagtttcaaataaaataatggaaatagatacatcatgcaaaaactaatgaaaagaagtaacattaatgtcatacataggatgcaacaagcattcatagatatagaaaaagcactacatattgatgaacgtttcaattcaccaggaggatacaataattctaagcttacatgcaccaaataatatagcttcaaaatgtattaatcaaaaaatgacaaaaccaaaaggagaaattgacaaatccattattatttagaaaaatttttgtctcaatatatgtcttgggccattgtatatcttgctactctcatctggacgatgtggtacctgccttcaattttgtttaccaagattaatactgaatcctcctaaagttctgacctccgctgtcagtccttcaaggatgctctctgtgacccccagacttagtcaggtgccctggcagatgctcttaagatactaggaatttcttagatgggaatacttacttaggtgtatgtgtgtgagcatttaattaatgcttttattagactgtaaaccctgtgagggcaggaattgtgtctccttggcaaatcactatacacagtgcctgttactgatggctgatctacttagaacaaatatttgctgaatggatagacgagtgaaagcagtcactgaactggcagccagatggccactactgcttttttgacatgcactttgtgccacaggatggaagtgcagaatgaggattaacttgtgacaattggttccctctctctcttctcctctccttcccttttcctctttttaagccagtaattagcacataaccttgggcaactgaggcaataagtcagtaactctacatactatttttagatttgctaagggcatacaacatgtactattcaaaaacgaaaagaaagggaattatctagtagggcacagatgttatattcacaatggtacatcctgaagttcaacacagggaaaagcccacatttcttcaaatcaatgtgcgtcccatttactgtgcctgctcccccagtccatgacgtcacttcttccagttattcttgtgattacatgtccttccgggaacaactggctggagattctggtgacttttaggaagtttgaggctccaatcctatcatcattttccaggagcaactgctttagctaaacctcccggtattctcagggaaggatctgacttaagttgcgtgaaagtatattgcaaatgtgttttggcttagacgtattttaaataagggcccatacatattaaaaagtaaagagagaaattacagcctaggggtttgtggtgtccatgtagcattaacataatgagtgctgtggcttacttgcatcctgcaaaaagccaccttgaagtcctaacccctagtacctgtgaacatgacctcacttggaaatagggtctttgcaaatgaaatcaagttaacatgaggtcataattggattagggtggctctaaatccaatatgactggtgtccttataaggagagacacatacacacagaggaatgcctggtgaaggaggaaacagagattggagcggggcatctccaaactagggaacaccaaggattgctggcaacaccagaagctggaaagaggcatgaatcagattcttccctacagcctttagagggagtgaggcactgcccacccctgattttggagttctggtctccaaaactgtgggaggacaagttcctattattttaaactgtccaatttgtaatgctgtcttatggcagacctagaaaatgaacgaaactacttacgcatcctttaaagctagctattaaagtttcctatttgataaagacttgaaaatgtaacaagatgcataatagcatctacaagtattcacctttcaatatgaagaatggcaaagggtgaccaggctgccaataagataaattatggagctggaatcagaggcacaacgttagtttttgaattaccagtcgtgtgggggaagctgtttaagtaaaagaacactgagaatgggatcagaacacttgggctggagtttccgtttagccgctttctatatatttcccctaagcactggtacaccctgttccttctgccagtcacaaactctccacctcccctcctctctcttcaacctgctcacctctgtccctctcctaggccttggctaagactccactcctgggaggtctgccctggttcctaggctgggttacaggacctcctggagcagccctgccatgctcacgggaatgtgcccccccttctctggatctacctggagatgggggcactccaggaagcctggccccagctcatcatagtccatgttgtacccacagagttcttggcacataagaattcatttttagctctaaataagtaaaggtatgaattaaacagtagcattaactttgccatagttttgcaaactcaaagtgtggtttacatgtgtcaacatttcaacttaaccacagattattttgcctcccaatggatatttggccaagtctggagaaacttgtcagaaggtgaactaaaggatgcaaagacaatctgtgcgtgcccctcaaagctgccaaagcgggcctggagtctgcaagtgctcgttagaacaaaacgtttgcttctagggccagtcctctgtgcaattagagttgtagtggtgaggttgtaaatcagagttgatagctcctattgttagggaatttagctgtaggaattgggaaatttgccatggtccctgagcactgaacccatgacccaggggtggcttggtttccttaaacttagtgcccatctcagttgatcagagggcatctatttcagtctctcagatcacgtggaatctcttgatcggttccacatggaccagcttctgacaccctggctgcagaacagaagcggcggctgggagaggtaagtctagacccaggtagcagggacccccctggacccacacgcccacacggccattgccctgagagccaaaccttccaagaggccctgaaagagaaagaacacaaccagccaagcttgggactggacaagccagtcagcagcactgaaccttacaggataagtcctaggccacggaggagccagtcgaggtcagcctggagtcttctttattcatgacattgcatctgtgcagcgcaagggccccgccaggaagacctggtccagccgcatgccttggctggggcccctgacacgctccttcctggggtcacccgcgtcccagcctggcccttctgggccacggtgcagctctcagggaccttcttcgtttcaccaggggctcctcacaccagagcttaccccaaagaagtgaacccctaagcccccttcagttcctaggatccttgactcctaccaagcaaacccttttgtcctcaccccttttgaatctcctttgagatctcagaggtaggcatctcctgctccattctaattcaggcacctttcccctctccagcaagttctcctgcttctcaggccgtggtgggtgtgggcctctgtgcgagccgctcccctgtgtgccttcggccgccactcctccctcagctgctcgcattcccactctgtcctttctccaggctgacgcccagccctccagacctcctaccccagttcagagccacaggtcccaaagcctccgtggatgtcctccaggcactgccagggaagaattattccacaaatatctgtatatcagtatgtgccagaaatcgttctgagtcatgccgatctcccagttcaccatcttttttgccccagtgttctcctattttttttttaactctaaaccactcagtaaatgacactgatgtcatcatgatcacagttcttcaaatcatcctgatttctcccctttcacggccctcccaagcccagccccttatccacactttgcatcctgtgcgtttgatcgctctgtcaccacacgcccgcctcgtccccatggccgcaatggccagaggcatggcttcatctcttcttgccgggttagtgcagttctctgctggtggggatgtgggcctccaggattcctccccaatctgtctgcaccgctgttcagatgtgttttaaaaattcaggtctggtcaagcccttccctactctacaccgtcaataatttcctgtacttttaaggataaagttcacatctctcagctgaccacgcaaggttctacatgcccgttccacctctttccataccgctccctaacaggaactctttactactgctcttaaattatccaaacgtagcacatttgaaaaatagccccaccatttagccaattgcctctcatcctttgaaacttttaagtttttccaggaggcttcctatacccacaggacacacatacatgcacacacacacacacgcacatgctcatacacacacatgcacatgcttacacacatacatacacacatgctcacacacatgcacatgctcacacacgcacacgcacatgctcatacacacatgcacatgctgacacacatacatacacacatgctcacacacatgcacatgctcacacacacgcacatgctcatacacacacatgcacatgcttacatacatacacacatgctcacacacacgcacatgctcacacacgcacatgcttacacacatacatacacacatgctctcacacacatgcacatgctcacacacatgcacacgcacatggtcatacacacacgctcatacacacacgtgcacacacacgctcatacacatacatgcacacacgcacatggttacacacccatgcacacatgctcacacacatgcacacatgctcatacacacactcatgcacacacacgcacatgcgcacacacacacattcacacaggcacacacactcatgttcatacacacgcatgcacacagtatgcacacacacgcatgtatacacatgcacacacacatacatgcacacgcttctcctcactccctgatttttatgctgtttttctgagggcctggagaacattgtgcacgcctccatcttaccatatacaactgctgcacaatctgcctttgtacctgagactgggcaagaattacttgagagcagaagccatgtctcatttgacaaacaggcagctggcacgggaaggggacgggcatttaataaatgtttctggattgaacacgtgagtgagttcgtatattcctgaatgactcgccattttagtattttcacctatcaccgccacgcagctgacttcttaatctgtttccagctctgccctctctcactagctggaatcccgtctccaactctctgcagccgactccatctgcgcatcactccgatctgtattacagtgattactccggcgtctgcatctcgtcctgaggtcctgaactttgggatggcaccgaccatctgtgactgtccgactcaaaacatcggtgcctggcacaggaagcatctcattctgtctctcctcaccccccttatgcatttcacccatcaccaaggcccatagagtctaccttgcagcgtctcaccaattcacctgtctctctaaggccactggcacctca

SEQ ID NO: 1298 - DNA, 1488 bp, Homo sapiens
gcccttaggctctgtgagctttcaatggttgacgggtgggatgaggagggaatctctacaatttaccaaataaagggggttcaatcaatgattttgtgttagactcaagggaagagtattcaacttcaaccaattattattcccaaggaatattgaaaatcgtttcctgaccaaagattttaatctcagctctcatgaagatttaggcttttcatgcatcttttctatattgttaaaaaaaatctatgtcttttgacatttgatgcttttccagtatgagagtatgtaataaatggtagactaaaactagggatctgcatgcacatttacagtaatgtttgaattttaatgatgttaatgtcaggctcctaaaggagagccagaaagtttttgtggcgtacctaatataccattcaaattagtactatttgttctccatccatccagaaatgtcagggcattactgatttacatgtaggacagtgtcttgagaagggacagtagtgaatttaaaacggggctgatctactgcagagtgtgatggagcaaccttatttattggcccagagggttgagggtctgcagaggaaggtggcaagggactgagcacaaggcttcactgtggacaaaactgtcccctaatttgtcccttggggtccagaccaaggcccttggcaaggctactaattaaagaaggggtcttgatgatccataattcaccctttttgcatccactcaatacctccttaaactcaattttccaaacttatacagggaatggaggacttgtagttccactgctggctgatttttcatctgaacaattccatccccccaacaaaaagcacacacacacacaagttaagcttgtctgaataagataactcaggccaactctctgcctttctatctctttatgaatatgacttctatctacccacatctcagcattgcagacagacaataatcttcccaatttgcatttaacagaggttaagcaaacctctctaaaatgtaacctgcgaagggctatacttctcgtgtatagctaaagagattgtatactaattaaatggaagtgcctatctagattaaagcaagaagtttcacgacaggaaaagtcttcatcagtgaggaaagcatgaagcataatttcatttaaaaatgtattttttagggtaaacagttacaataatgcagattttcacacaggaggtccctagtttgttcatcctaattaggtatcttcttttttcccttaccttgagcaagggcaatccttttaaacatacagcagaatagaagcactttttaagtacttcagcaagtcagcaaagggctttctgctcagcagttgctctactaagaaatcttcctcctcattcctgctcccatccccaagacacattccagagtttaacttatcctctttgatggctcctaatgatctttattcaactatttgtcatcttcccacccacatttaaa

SEQ ID NO: 1299 - DNA, 4250 bp, Homo sapiens
ctgaacaaaccccttctgagcctctcccaggaagccttatcaacccacagtccagaaccaccttcaccgtttgagaacctcacaaagggtacttgcagtgctagtgatgcctacagactgcttggccttgtacttgagatggagtgaagacgagggaaaccccttgattgttctcagttttcccctttgtgccttgaaatttccatctcattgtgaataaaaaagtcaaagcatattcaatcccagagaggggttgaatccctgaatttcacaagattgaaagatcatgaaaaaattgaccccctctggaaagatgagaaaaatcaaaaagatcaatgaacacatacaaagagtctgtatctatggctcttattaacagtgactaaagaatttatctgagtaatttagctaattcaactcaataaggaaacaacataataaaagatataactgaaaaaatgaaattatcaatttggaaatgatatgattaagaataaaaaacaagattgtttttgaaaaatcattgggcctaataagacatgtaattaaagaagatgattataaaaccaacaaatataaaaagcaactagcttctctgtacactatcaataaccaattagaaaatacaatcttaaaaaacaaaagattaaatattcaagaacaatcaaaatacaaaatgcatatgaacaaacttttttgtttgttttggggacagagtcttgctctgtcacccaggctggagtgcaatggcacgatctcaactcactgcaacctccgcctccccagttcaagtgattcttctgcctcagactcccaagtaactgggactacaggcacccacccaccacacctggctcaatgtttattttttagtagcaatggggtttcaccatgttggccaggctagtctggaactcttgacctcaggtgatctgagtgtcatggcctcccaaagtgctgggattacagacatgagccaccgtgcctggtcatgaataaattttaaaagaattgtgatgacttacatgaagaaaatcgcacaagtttactgagtgacattttaaaactttaataattgaaaatccattcaatgttcctggtaagggaacagaattaatggtcagaaacaaatcaaatatatataagaacctaggatttttttaagtgcatttgaaatgaatagagaaaaaagggatcatgtctccagcacattgatgttcctgcttttctgaacacacttaactctgtgttgcctgaagacctctgtacttgctgttccctctggcctgaacagtcttccctcagagcctgtttctgatctctgctcaatgttcttttaaaggatagcagtgtcttggggtctttataactttggggcttatctatggctagcaaatgtaggacataggtgtgtagagtatgcaaagcaggaaggctctcaatggttaaatatctgtttatctggttatgtttaaaacaattggatgtgtaaaaatttgagcgtggtgctagtgggcatttaagctaacagatctcagcctactatgaagaagtcataaacccaggagtaatatacagaagccttctggctcatgtgcatgacacaccccacctaattctcaagctcctccctcttcattttttattatagcaactatcactctgtgacattataatctatatctatttggttgtgtgtctgttatctgtttttctcattagaatgttaactccatggaggcaggaaccatgtcatccttgttgactgcattttcagtaccaaaaaaaagtgagtgcctggacagaatggaaacctaataaacattcaccaaaggaagtaggagaggagaggggcaggagagaatatagtaaaataggttaaagtttccaatatagccatgaaattatttttaggaaaagaatttcaataactcgcatagaaaaagattttttaagcatgataccaaggcagaaatccttacaaaagactaacagattttactgcaaaatataaaatttacaaaatttaaattgtaaagatttttttaatacaaatagaattataaacggatttaaatgtttagaatataaataatatttacatagctgatcaagagttaatatactcactaaaaaaggactttctacaaatcaataagtagaagataaatacttaatacaagaataaatacaaatataggaacaagtaagatacacacaaaatgcaattcaccagtaaacctgttttaaatgtttaattttgccaaaaactaaataaatgaaaataaaaataacaatgagttaccaaattttccaataagaaaagaaagtaggttttaagaaattggtagtgcattaggccatttttattaaataaacctaaaatggtatcaatgaaatatttaaaagtacccctgggttacattttgctttttggtactttctaattattccaccaatatgtattacttatgtaattcaaagaagtgattttacaagaaaaaataaatagtatggtaaatcgctggctcctagagagtgggccaatcttggaaaacaatgccccagtgctgagaactgtgtaggtaagttgcatctttcagtagcacaaaggagagattggtttttcactactttagatgagggccaggagctgaggggttaatagtgcacagataaatcttgaaggacaaatgaagttttccacatggccaaaggaaggagaaattataggcagatgaatagaacgtgtgaaaagagaggaacacaagacagcatgggccaatgtagcatcataataaaaataagcaacacaaggccaggtgcagcggctcatgcctgtaatcccagcaccttgggaggccaaggcgggcagatcacctaaggtcaggagttcaagaccagcctggccaacatggcgaaactctatctctaccaaaaaaaattagccaggctccacggcattccagcctgggtgacagagtgagacttcatctcaaaaaaaaaaaaaaaaaaaaaaaatagcaacacttggaattctcagtttgtagaattcacaactgatactaaaagtctatcatgtaacagggctccggttgaagttcacctcactggttatgagttaaagacagggtttttgatgagactgacacagaaaatgtcagcaagaaaagaaaggacacatttctctgatctcgcactctggggaatgctggaacaggtcatgagtgtaccttctgcaagaggggcccagctccctttctcactcatcaagaagttgctcaactttctaatatatcagtagataaagcaagtttaccagtgaggggaagctagtggtgggggcaggaactggaccacttgggcaccagagggtatgattttgatgtcatttgtttagctgcttaggaaagccacccactgccagcttaagattcaggggaagttgagatcaggtgcagccccacctcctgacatggggaaaactcattgtcctcactcattcatcatgcaggcaacctggggagaatttccacggttgcttttggactgccctatttgtgataccagagctctatgacatttcattaattttaattttactgaggctgaatttgactcactcatgcttgaaaggtagggtgtataacacatcactaaacaagcaaatgaggctgtggaccaccagcagtcacatctcaactagacttctgttcaggtatttatcagcacatatgcatgctcactcacaaaatgagtagccacaaaggggtgctaattcctaatgatggtggtggccgttaagagtgaaattggtagttcttggacagaaaagagagttctggataaatgacaaagaagaaaaatattaacacatctaaaagtttgcatgtgaatacagcacttggtaaaagtaaaggtgatttgtgaagctgttttaataatttcttgaaccaattcaaaaattgctcatcaacttaaaaattagacaaatgaatgatgaaacggtggttaacagagtgttaacaggtcactgactcatttaagaatccatgcaggccaggtgcagtggctcatgcctgtaatttcagcactttgggaagccacagtgggtggatcacgaggtcaggagttcaagaccagcctggccaacatggtgaaaccccatctctactaaaaatacaaaaattagccgggcacgatggcggttgcctgtaatcccagctactgggaggctaaggcaggagaat

SEQ ID NO: 1300 - DNA, 2036 bp, Homo sapiens
actgctgaattgccaacacatagaatagtgtctggcacgtggcaggcactcattagatatttgtcagctgtctgaacactgaacattgtctaactgaccagactgtcccccttgcattggttatgagaaagctttcagtgaagcatgcggctgatctttagcgaggatgcagatttgcagggtaggtatcagctttattcctggctttgtttttgcttttctttcccatggatttctattgtcctttctaagacaagggagaggcatatattaatacaaatatatgcacagtgtcagttttatcatttacatatcaacagtatcacaacttgttaaattctggttacgggctaataagacagaacatttcttcaagtggatattaggtcccaggcatatgaaaagtgcttttcatgcatgactctgtcaaatccttatgacaatccaatgatgtagacatttttgatatcttcatttttagagatgagaaaagcaggcttagaacggattacataacttgcttacagagccacatttgtaaatgactccaggtcagtctgatagcaaattgggtccaagttttacacattttgcttccctgctttcactgatgtttgtctttacatctccccttcctctccagcatagtgttaaatgatcgatttttggactattcaagctttttatatccattaactccaattaattggatggacttatcttccttggtaagttgcactaaataggacataacaaatacctcctctttgaaacaattagtcaagagctaagaaataaaacagagcttctttgacccactgaatatatattcccccaaaatatttattcacatggagtttacatttttcttctcagaaaacgaccattttataacaacagggtgtattgctcaagtggtctgcatggagctgaggtctgccaccatgctgtgtgtggcacacacagagggaggagggcagcctgatggctagtgggattccccactggtggtcaggccccagccaagttgctgtccctgtctgcaaaatgaaaagcttgaactggatggccttaagggtgattttcagctcgaaaatcccaatatcctaaccctcaagcttgggttagatccaactcctctgtgctcttcctgtaactaagcaatgagcccagtctatggtaaatcccccacccctaatcctagcctgtgacagagggagaccaagtgtctctgggtctctgtctgcccccagcaccttgagcagggcctggcatgtaggagttgttcagtagatgtttgtgaaatgaaaaaatgaatgaaaacaagcatacatggtctactcctctatttctttctcttaggtgacttggtttatcgtgtgagccattctggcagaagttagacttcatgtaaccccataatgaattcctgtctagtagatcactctaataggcaaaacatatcgcagctaccctctgccggcttcagagactggggtcactatcaaactggtccctggcccacctgcttaaatgctgtggctcctaaccactctttgtgactttgctgcagctacagatatcaagaactccagtgggccatggtacttcttggtccatggccgagggattatgcaaaagctacatccatgcaggagatttccttcatatttggatagtttcaaagataagagcatcttataataaaggggaaagaaacttcagaatgtcacaggcaaagtcttaggaagtgaagatataaagccaaaataggagtaaaatgttcgtacttgccatgaagttaattaacattcttacttggaaaaagtcaaggtcaaacataattcatcaaacataattcagagttacttggctttaacggaagtgattcctcaagtctcccttcaggttttaagacttattatggaaagcataataaagtgtcctacgtttatacatctgctgaaccatgttatgaaatccagtacactgtaggccctgggatggggcaaggagccattgtccctctttgcagg

SEQ ID NO: 1301 - DNA, 2776 bp, Homo sapiens
gtttggcttccatcctcaagtcctccccttccctagtcttcccttctttaataaagtatgaattagagaagtaatgttagcagctatgtgctgtcacttgctgtggctgctgtgggctatttattttttaatttccacgctaggtgttgcctatgttttgcttagataaagtggctatacagctaagctctgggatggaggttaatattactacgccggtatgaagctatgaatgctttactagcatcgtcaatagagacccttagaaagagtaactacttttacacacagacgcatactaccagtaaagactgaatccagaccacctggaatagaaatcaatgaccaaatgcaatgtggtattgtgggtggaatcctggaatacaaaaaggacatcagataaaaactaaggatatctgaataatgtatggacttcagctactattactattactaatggtaatgaatataatacactgctgtaagatgttaataacaggagaaatgatgcaggggacatgggaactcagtgtgctctctttgtgtttttcttgaactggactgaaaaacaaactttcactaaaaaaccttttagtggtataagattctgaggatttgcattatctgcctgttgcccagaacttatatggcatgttattattattttaaaaaacttctctttttctcccaaatcacaatagttcaaaaactttctaaaaatgtttctcctttgctcacttcttttgctcagcagcaacttctctttcctcttttctctactaaattttagtagagaggaagtaaaaataccacttatttgaacttgggaggaagaagaggttttttaaaaaaatatatatttatgcagtgcctcattccacaaaggaattaagagaaaaggaaaatagttaaatacatcttccttttcccagattccctaaaatagtctaggattatgaaacagtctatatttctatgatggaaagtatctttcatgcaatgcttcagagttaacaaagcatttccccacagcttaccacacattatctagataacaaccactatgaggtttagaattatccctatctcataggctctgagaggcgaaggatagccttcctaggtaggcagagctgtctgcttcctgcaaatcccgtgattgctcctccacccagctggcccttgagcccaggctgtctcatgggaggcaggcttgaatggattaagcccacagaagcaacttgccaaaatctaaatcaatcctaagtttataatcaccatatccacctttacctacacacaatcttcctgcttcctgaatataaataagccaagaaagagtcagttgatctttcactgttgcctataacaaattttttcttgactccttttaaaattatagagaatatgtataactatccagtaattattatgcacaatttcaatagactaactcagggctggcctctgaaagagagaaactgcttttctacacatataagtaagtcagaacatctcagatgacactgccagaaacatcaagcatcattttgctcataaggaatcccaagatactagtcctcagtaatgagaaaaaaagcccaggcctctgcccagtggtcttcctgtaaaagaacgacagtgtggaactgacccacttggagctacttttcaggctttgagttggccaaagaaagaaccccagtatgctttctttctttagaccagcagtttacattttatattttgatattttgcaatcattggtgaatcaaacacgggaatgagaatgatgaaaacaaaacaaaacaaaaagaaatcaaagtatgagacaaatcaaagaatgaaggaaatgtctgccgttaatcttaattctctgaaactcatggagggatcaaggggaaggccacaatgtgtatcttgcatcagattttcttaggtcaagaaggggcatctttgaaagatcaagggagtttctggagcaaaataacagctaacacaaattcaccttctgattttttcttaagggaacctgggaatgctaagtgattccagtacaaagaacaaaggggttttcaaatccttttcaagcttgtgaaaggcactgggagacactggaacaactcactatgtgcttgctaatgaaatagaaattttccctctatgtttacaagccagattcactgataagaaaattatgatttaggatcacaattttccaaatattatactttttagaaagatgtcatagttggtcttaggtagtcactgttgttgcttatttaacttgtaaaggagaaagagaaagagctgaaccaaaatgaatgtctacaggcatagagctatggctggctcacctttctgtccccaccctatagcactttgtctgtaatacaagtttgttgaatacaaatgacctggcatttcattttataggccaatttaacagaatagcttgttaaatcagaaatagctcattaatcggtgttccttcctgtctctgcctttccttctctctctatagctggtgtttgctttaaaacacctaagcaagacagctgggctgaccacaacagtggattcaggttcaaaactggactgacatgacaccttggccccagttaaggctgggctcatttcggcttacaagcacgagagatatgtaagggaggactaatgcccagcagggcaggttcagctactccagcgtcacctgttccccatagaatcaatacattaacattccagatctttttgagtaaggaaattctggctg

SEQ ID NO: 1302 - DNA, 1344 bp, Homo sapiens
attacctagaagccttgttaaaaccctagtttaaagccccagaacccagccgggaatggtgactcatgcctataatcccagtactttgggaggccgaggggggcagagcacctgaggtcgggagttcgagaccagcctggccaacatggtgaaacccccgtctctactaaaaatccaaaaacttgccgggtgtggtggtgtatgcatgtaatcccagctactggggaggctgaggcaggagaatcacttgaacccaggaggcacaggttgcagtgagcagagattatgccattgcactccagcctgggtgacagagcaaggctctgtctcaaaaaaaaaaaaaaaaaaaaacccagaacccagcatgcctagtcagtaggtttggggtgagactcacaaatgttcacttcccacaagttcccaggggttgttgctgtggctgggctggggcctgctctgagaaccgctgtttgagaccacgtgcaccagaatgcctttcagcctttccatcattttttttttggttgtttgtttttagaatccacaaaatgtatgcactgtagtttgagtccatcaatatatggctcaatttctgtttttaatgataactcgaggaaacagaaatgtatcttgttgtgaaaaatgttacctccatcaaacaaatgcctaacaccacagcattagaattgcactctgatctttccatttattcaaaacagcattaagtgatttgatttattagtggcagcctggggtggggggaggagactctgatagtcacaaaaccaacgcatatgcgaagagtgggctttgcaatgtgcttagaataagtggaggaatttcttttgaggaatgtactttgtctgacataggaaggtgcatgaaatatgaatgaatagaatgcttgctgttaaaaatttcttttcatgagctacaacatagataaattagagatttaagtgcaggggacctcagacttcagacagctggagagggaagaagatgggaaaaggaaaataattttctcttctttcttttttaaagacagggtcttactctgttgcccaggcgggagtgcagtgacacaatctcagctcacttcaacctccacttcctgcttcccgggctgaaggcaacgtcccacttcagcctcctgagtagctggggccacaggtgtgtgccaccatgcccagctaattttttgtattttttggtagagacagggttttgccatgttgcccaggctggtcttgaactcctgagctgaagcaatctgcttgccttggcttcccaaagtgctgggattacaggtgtgagccatggtgcccggccaggaaaatgatt

SEQ ID NO: 1303 - DNA, 1666 bp, Homo sapiens
aattgtgttggaatgcacctgtagtcccagctactcagaggactgaggtgggaagattgcttgagtccaggaggttgaggctgcagtgagctgtgattgcactattgcactattgcgctccagcctgggtaacagagcaagaccgtgtctccaaaaaaaatttaaaaattagctgggtgtggtggtgcatgcctgcaatcctagctacttgggaggctgagacaggaggatcacttaagcccaggagtttgaggctgcactgagctatgattacaccgctacactccagcctggatgacagagcaagaccctatctccaaataataataataataataataataataataataataaagaggaagtgaggtacagaagtagctgattgcttacagctcaacgtttgccttatttgaacacagtttgaacaaatttggattggccaaggagagagatttgtttaaatgcctccctccaaagccctgtggttgataagtgatttgccaaatctaaatatacataatagataatttctggctgcttttgtttgaaggaggtgattagttttttgtttttgttttttttttcgctgttgttgttgtagagacagagtctttctctgtcgcccaggctggagtgcagtggcgctatctcagctcactgcaacctccgcctcccgggttcaaacaattctcctacctcagcctcctgagtagctgggactacaggcacatgccaccatgcccagctaatttcttttgtattttagtagagacagggtttcaccatgttgcccaggctggtcttgaactcctgagctcaggcagtctgcctgcctcggcctcccaaagtgctaggattacaggcatgagccaccacgcccagccggtgattagttttctggactaactgccatttttctgcagtgacacacaatcatagacacacataccgagcagtgtcttaaccaaggcttggctcatccatcggagctgagtgtgttcttggagcgctaactgaccatacataagtttcctattgaaaattcgagtaaaaaatgcagaagggaagaaggtcgttttttgcaatgaataattaagctaaaggacgcatctttaagggaaggtagggggatggagaaagagctaatagtcatattttccagtctttatgagaaatgaatgcagggacattgattcagaaatgtttcagactgaggctgggtgtggtggctcatgcctgtaatcccagcactttgggaagtcgaggcaggcagatcacttgaactcaggagtccgagaacagcctgggcaacatggcaaaaactcatctctatgaacaaaaagtagccaggcatggtggcatgcacccacagtcccagccagttacttgggagactgaggtgggaggattgcttgaacctaggaggtggaggttacagtcagctgagattgtgccactgcactccagcctgggcaacaacagcaagactctgtgtaaaaaaaaaaggaagaaaaaataaaaataaatgttccagactagcatccaaggccctcccaaatattgccactttatcatgttctcccctaagtctctgtgatgtgaactctatgattgccttaaaagaaaaaccttagacaaattaaatttaacagcgtttaattga

SEQ ID NO: 1304 - DNA, 1694 bp, Homo sapiens
tggttaatgttcttggtttatctactgggcctcataatttttcttacgagtttgtaaggctatctctgttttaaggatagaaatccatatgcatgtaacatcaaactcaaagctagtatatggtatgtgtgcaatctctaccctcaggaaaaactggcttatgtctagcagggaagaatatgaggccagccagtgaggagtgagtgcaatatgagagctctagggaccccgtttaattacagtcatcaagtacattactagcgcaatgagaaattcagaaccatcccaaatcaggaagatgagcacagcaaagagaaaaccaaagaagggcatttggagaaagttctgagagtccaggccatcccttgtggcttgatttgccatttacaaattcctggactggtaaggaccagattcacatatgatcctgctatcaggcatgtattggtagtcaataaatgcatgaagaaatgcattattgaaccaacccagagtctaactgacctgagtatcccagagtcaacccttccctaaaatcatctccagtcaacaaagggtctgatatggtttagctctgtccccacccaaatctcatcttgaattgtaataatccccatgtgtcaagggtggggtcaggtggagaaaactgaatcgtgtgggcagtttcccccatactgttctcatggtagcaaataagtctcatgaaatctgatggttttataaatgagagttcccctgcacatgccttcttgcctgctgtcatgtaagacgtccctttgctctttcttcatcttctgccatgatcatgaggcctccccagccatgtggaactgagtccattaaacccctttgctttgtaaattagccagtcttgggtatgtctttattagcagcatgagaatggactaatgcaaagtcgatctaattaaaccacaaatatccaagtcactacttcagggtccttcatttctattttcttcttcaaacatccaagcagaatctctgcatatcatttggatagttggccagtaaatgcttcaattataagttgaaagaaataaaataaaatcatctggtggaatggttttaattagaatttagtgagttgggcaagcaattagcgcatctaagaatggaggctacatacgcatatttgtctccgttgagcttcactgatttaaatgagcatttgactcagatttctcaagttaaacaaaggccatcataatgacaataacaagaagaatgtagcctgagctaatagaaaaattgcaaaagctatcactctttgtcctcccagctctcagtggatggattttatggcagtaccaccgcctccattttagccaaggcttgaaattctcaagatgatcaggaatattaattaattttaaattttcacatagaaagaggggacaatgaaggaagaggaactatcatgtttgagcaatgctgtatgccaagtacgctacaagaaatttatgtacatcatctctctactactttgtaccagcctgtgtggaggctgccataacagatgcaattaaaaaacaaactgccaagtacagtggctcatgcctgaattccaacactttgggaagcctaggtggacagaccacttcagtccaggagtttgagaccagcctgggcaacatagtgagaccccatctctacaaaaaattgttaaaaattgg

SEQ ID NO: 1305 - DNA, 2245 bp, Homo sapiens
ctcaaccctttagtatgctttagtgtgagaaagcttgtaaaaatgcctgcatggtgccttgctggtgcccagtcagtcctgcatttctcggctctgcaaaatcacagacacatggaatgggatggtatgccccagaagaactgggggattgggagacctggcaggtgtgagccctgggtttgggaagggcagaaggtaagtggtgacagataagtctaggaaggcatttgggtgtcaggtcataaaggaccttgaaaaaccaacccctgggttagttgaagctttggtttagtttggtttcacggaggaacaggatgatgagatttttctttaggggaagatgacggcagcaataagagtgttggaaaagtcaccctgaacaacttttgtaggtaacttaagggcagaaaaaaggaactctttatttttcaagtggcatcatggctatcacagctcatcagtgcctggaacaacacctttaataatgtcaataggaacgcttcgaactgctgcagaaattctgcttcctgaatgtttgaacttaccctcccatttaatctttaaaccatcccttcaagagagggaggacacaagggtttttctcaattatgtaccactgtgagcttggcttagttaccaaaggctgatgatgggctcagcagtgggatccgagtccctgcgttcccacccaggcttcccaccattttcctcttaggtgcgcatccgctttgaagctgcattctctctgagacatgtggtggtaatgataatgttaatactagtaatgatcatagtaatcgctaacattgagaaagcatttacttattatatgccaggaatacgttgctagttttgaattgttttgtgtaattatcatctcctctttccaactaagaaaactgaacggtaatgagataaattaccctaggacacataacaagggtgtggtaggatagaaccacacccttcccaggtgaggagttgcctgtcatttctcagggtcctccgtggcacctggggacaggtggaggtgggcgtgggttgtcaggacatcaggggcctaactctgactctgcgtcaatcagagaagcttgatttttatctgtttcattggcctttctcaaaagagttgatttgagaaagtgttttttaaatagctttttaaagcggaaaggggccgtgtgcgctggctaatgcctgtaatcccagcatattgggaggctgaggtaggcagatcacctgaggtcaggagtttgagaccagcctggccaacatggtgaaaccccatctctatgagaaatacaaaaattatccaggtgtggtggcatgcgtctgtagtcccagctactcaggaggctgaggcgggagaatcacttgaacctggatggcggaggttgcagtgagccgagattgagtcactgcactccagcctgggtgatagagcaagactccgtgtcgaaaaaacaaaaacaaaataaaaataataaaataaagtggataggggttgattggggtttttcttttttggaaaaaagcaattaaaaagaagatggattgatagatacataatgagctgggtagatggggagacacatgataaagcaagtgtagtacagtgttaataaagtcagtggtgggtatataggtattcactctaaaataccacttttctctatgtttgaaaattttcataataaaatgttggaggagaaactagccaagtaaataatttctaagggcccttccaattttttaaaaaattttatttcctgcacttctctctacatcctatagttgtgatcatgtacaaccatgacgtgatcattaatctagatagatctcctagtcaccactggatgttgccactaaaaaaaaatctaggctgggtgcagtggctcacacctgtaatcccagcactgtgagaggccaaggtgagtggatcatctgaggtcaggagttcgagactaggcagaacaatatggtgaaaccccctctctgctaaaaatataaaaattagccaggtgtggtggcaggtgcctgtagtcacagctactcgggaggctgaggcagggagaattgcttgaacccgggaagcggagattgcagtgacccgagattgcgccactgcactccagcctgggtgacagagcgagactccgtctcaaaaaaaaaaaaaatctgctggggagaacaaagtcaatcatcactcatttggttctccaactacctgagcctaaattttgat

SEQ ID NO: 1306 - DNA, 2244 bp, Homo sapiens
gatactaagtacaaattaaggaaatctaaataaactatggactgaagttagtagtgctatgttagtattggttcattacttctaacacacatgacatactaatgtaagatttagtaataggggacactggatatgaagtatatgggaatgctctttgctatcttctcaatttctctggaagtctaaaattgttcttaaaaagaaagcctatttaaagggaaaaccaccatcactaccaattttgataaacttgaagggttagcatcaattatctggaaaatttatttgtgagaaaaccttattcctttatgatcattgataagtgaagcattgctgaattatctctgcctctctgagcaagttaatactatatttttaagagaagaggagaagagaggggagggagtagggaaaagagtatgtgtatctttgtgtgtgtatgtgcgtgtgcatgtgcgtgtgtgtttaaacaagagaaaaagtgaattctaaattgttaaaaccttggagtggaacttaatctaatttatacgcagttccactagagatgtgcaaggatttttttgttgttgttaaagagaaaaactagtttcaagcattattaagcttttttccctcccagaagctaagaaaaccatctgtgagaacctgtttgcatgtttgttttctacaataaaatgcaaaatacttcttcctgttagcggattataccatatgtctctccctgtaacaaaatcagcatgtttattaatgaacccaatcagaggcaaagatttagaaagatttaaggaactgaattttccattcaatatttcagcaaaagaaacttctggttagacatcgttgttgtgcttggaaaatagaaggtttgtttttgctttgaactcaatttacttggcaggggacagagagcaggaagagaggcctttgaaaattttcgtaaaaaaggtctgcatttagaaatggcccttcctgcctaatgattcccctacggatttagacctacagtttatatgtgactaatatttaatttgatcagttacatttttccagacagactaattaaagtgcttgatggcccagatcccccaaatctgaagcagtaacaggcctgtgggcttcctggagtaacaggaagtgaatgaagtagtttcagccatattgtcaaagcaacccccatggtactcataatggaaacatgtgaattttccagcacaaacactttcctcacagccctgttgaccatctgaataatcaaatagattggtagcactaggtatagcatagtgtattagaaagaaatatgtccagccagacccagcactgcagttaaagtactggtgctgtcacgagccagcagaaggcctggagcaaatgacgtactctctctagaccccagcttactcctctgacaaatgaggatatcagctctgctgttctcttgtttctgacttgtagaagaatggacttgtcagcagagaccgtaagcagtggaaatcccaaaagccagacagaccctgtgcgtattttaggggatacattctgttctggtcattcagccttcacccaagccatctttttttctatttggtggcatagacacagcccagccaacctaattctcattttattgcattcattgttcatgtgccacagttttttagaaatcttacaagaaaatgaagcacctattaccaggacaccactgcaagggggaaaatgacacttgggcacctggaaggacaaagacaggcagtggaggcatcatggggttggattcgagtaaccctctgccttcttcctggggtctgttggcagtgtttttgtgctgtggtcatgatacacacaggtctcacaaggcaggcagccaagtgttgactctgtctttgtaggcaatacagaaaactgtctacttgttccagtgagctaaatcaagtgagaacaggaaagaggtttgtgcaactttggcaactatagcaggaaccactttaaatgggacagggcaagtaatgctaaatatttgcaaggtgatttttttttttttaagactttaaaggttgtattgggagaccttgagaaagaggcctttctttcttttttttttttttttttttttttgagacggagtcttgctctgtcgcccaggctggagtgcagtggtgcgatttcggctcactgcaacctccgcctcccgggttgaagcaattctcctgcctcaaccctcccaagtagctgggattacag

SEQ ID NO: 1307 - DNA, 3587 bp, Homo sapiens
accgtctttggttccctgcataggctgtgtagtgggtatcagtcagcacttgtctgctggttgcacaatgcagattactcacttctgcccaagtaactccctgaagccgtactgtaacaatagagcatataaaaaagaaactcaggttgatcttggcccctgtccaaggggattagctagggagcacctgaaaggcctgtgttgaacacactcacctgtaacccagttccatggcctggatctcaaggacagggtaatctcagtaccttttaatgacctagtaaatgtggtatctttctgtctttacactcgacctgatggctcatagagtctcctcattatggagctggaggagtactttgaggtcatctaggccctcactactcaaagtgtggaccatgggtcagcagcattggtatcaccaaggagcctgttagaaatgctgaacctcaggtccatccctggatttatagaatcagaatctgcgacaggttccccagatttctcatatgcattatgacaggtggggttgtcccatgatccaactctgagatggagtttagccagtggcgtatttattaaggagtgccctttggatcaatacctatgggaaggaggaggaaggaacaggaataggtaggtagagcaagaagtcaagcagcaatacaggcccagtgacagtcatcactcacaacacgggaagctacacagctaggtcagccttctaagttgtctgtggtgggcagggatggccaggcctttcaactcactgcagacagcactcccagcagtcagcagcaagtctgtcattagacagggatctgggtagctcatcacagtgtccaccacatgcactgaagttgggagaagctctattctgggtcactggttctcaaaatgtggctgcataccaacaggaccttcagcaccccggggactcattagagatgcacattcctgagccccacccacagctactgaatcagaaactagggtggggctcagcaacctgtgttttcacacgttctccaagtgagtgctgcatgcccaagtttcagaaccactgctccaaggcagccttttttctgtttgttttgttttctaattgttattgaaatgattcacagtccatcttaataataaaattcaccactttaaagtgtacaattcagtaattttgtggggtttttaggttttttgttttgttttgttttgttttgtttttgagacgaagtcttgctctgttgcccaggctggagtgcggtggtgccatcttggcttactgcaacctcttatctcctgggtcaagggattctctcgcctcagcctcccgagtagctgggactacaggcgcccgccaccactcctggctaatttttgtatttttagtagagacggggttttgccatgttggccagactggtctcaaactcctgacctgaagtgatctgcccacctcagcctcccaaagtgctgggattacaggcacgggccaccgcgcccggcccaattcagtaatttttagtatatttataacctgtttagtatatttgcaaccctcgcctttacttccagaacattttcattatccccaaaagagatcccacacccattagcaatcactctctgcaccccctcccaaagtctggcagccactcatctgctttctgtcactgtgaatttgcctgttcttgatactttatttaacttgagtaatgcagtatgtggcttttgtcttgtttcttaacgttttgagagtcagccaagctgtaacatgtatcagtactccatttccttcatgggacaaatcatattccattatttagacagtaccacattttgtttctttattcatccattgatggtcatgggttctttctactgtttggttattgtgaataatgctgctgtgaacattggtgtacaagtttctgtatggacatatttcttcaattctcttgggtcaatacctaggagttgctcagtcatatgttaactctatgtttcactttttgaggaactcccagactgttttccaaagtgactgtaccatttgacattcttacaagcagtttatgagagttccagtttctccgtattatctccaacacttgttaatatctgtcctttttattatagccattctagtgaatgtgaagtggtatctcagtgtagttttagtttgcatttccctaatgactaatgatgttgaacatagttttcatgttttcattggctatttgtacatctgctatggagaaatgtctattcagatccttcttagggcagctctttttgttccttaaggaatccctcagtatgtcagctttgtgtccagtcctgtgcaggtgttttaggatttatgaaacaaagcctacaacctgtggccattacccactggaaagttctaatcagatgtgaaactgtctaaaaaggggaaaggaggacaggagagcccactgtcgagggttagcatgaagagattcacattctattacaattcgtgcttcagaaagacacggtgtgacttgctaggatagagtggtgtgtgtcagggatgtggcggctgcagactgctggagaagactgggaatgttgagaggaagaggaacaagtagagaagcggggacaggaagttgtgggcagaccttctagtattcttttatgggttacacacacctgtaagaggggatctcaggagcccaagatttctttcaagatcatgaccttcaccagcctcagcaaggtgaagcagttcacctttttcttcatttgggcaaaaatgacctgcctccaccatttctcagagtgtttgtaaagactgattataatactctaaacaagtgcttgaagagtgtgatttattctacattacaggtgagaaaaaagtttgtaggtgtccttaaatagtctctgattccctattagcagatcctcatggtggcagtgccatgtccatcccaaccccccagggcaggtgcctctctcaagatacctgagactaccaggcacatcctcagggctcccaggcagcttctctttatggttgcaacacaccttgaaaatgacatattggggcaaaagaatttcaaaacagcaaaacctttgccatcatcctctcacatagctagggcctctgcacgtatgataacaagacagctaccttagacttatgtcatgccatctaacttacaaagtgctctctcaaccttgcaccagaggaaaccaaagctccaggaagtgacttggctaatgtcaccggttggactgtagcatgatcaggacctgacccctggtacattgacacctgacccagtgttttcatcgggcacttttaccttacaggttgctaaggattaatgatgggatgttttgattcttagtctataagtggatcctctcccaggaggctccaggtctccggatgccaggcactcatgttttatttggtgttgcagctgtgtttcattgtagtaacatattccaaatgctatgagatcaccctgagtctcattgaagaaaagtgtttcaaaagtatgcagagaggtcaaagtattaggaaagttctagaatgtacttaaattctc

SEQ ID NO: 1308 - DNA, 2033 bp, Homo sapiens
ctgccttagcttcctgagtagggtagtcatatgccaccatgcctggctaactttgtatttttagtaaacggagttttgccatgtcggccaggctggtctcaaacctctgacctcaagggatccttcgccttgtcctcccaaagtttcgggattacaggcatgaaccgagcctggcctcaatacattcttcctaaacttttttgatcatcaagattttctttgtttcttatgatgttttccattattttaaatttatattagctgtcatctaaacaaatcatctctgcagtggacatctgtttgagagagtgcttccagttctcatccttccaagaacagtaacctgaatttacttcccatccttacccatgtgtgcttgggggctgatactacatgtaggtgtaaaccacgtggtatatccgtcctggtcaaagccagcaaaccacgagaacaccttttctagggcttttggaaaggggaggtttctcttccttgcaaggaagctgccagaggaactgttctttctttggatggtgatgtgttctgaaacaacatctggagctgctgtagccactggatcactatgagctgaggctggaactgctatgagagccccaggtggagcccagcctgggaggaagaggagttccaaagaatcagcaccttggggttttgtttgagtttctgttgtaggaagcctcacctaaccttttgaatattcaacccatgaaccaaaatactctattgttgaaaccaatctatattggttttcttggcaacttcagtcctaaccagcataaactcattattttattttttttctttttgagacagagtctccctctgccacccaggctggaggggcttgatctctgctcactgcaacctccacctcctgggttcaagtgattctcttgcctcagcctcccgcgtagctgtgactacaggtgcatgccaccacactcagctaatttttgtatttttagtagagatggggtttcgccatgttggccaggctggtcttgaactcctgacctcaagtgatctgcccgcctcagcctcccaaagtgctgggattataggcatgagccaccgcacacagcccatagactcattcttacagaaattgtgcttcactaccttaaattttcaggtagagcatgcactagggattattatatctgagtcgatctgcaaatattttgaagcaaacacatcttattttctgtttccaggctggccagagctttctgctgcataatggcggcagcgattacattgcacgttgcttctttgacatctgagatgtttgaggctggaaactcactgcctcaggccttctgttagtgagaaacgccaattaagttcagtgaataaattgagctgcatgttagctttcagacacagagaagttccgtactgtatctaagaaacttcccgaaatgtcttgttccagtggatgacgtaacttgtcgtttgactaagaaattgcatcttaggaaattatctcaaggaaataagcagacaagtatttatacacaaggaaggtataagccagaggattactgccatgctgtcattccccgggaaaattgggtatagcatttaaatgagcaataatgggcaattgattaagtaaatgatgatacattcatggcctgccatgctatgcagccattaaacaatgatgttgatgtatatttttgacatgaaattatgcttatggtacactattaggttaaaaaaagagacaagttatatcacagtaagtaaagtataattgcattttgtaaaaaattgtgtgtatacatatgcatataaatgagatgtatacatatatatatgcatgtaaaagattagaggatatatcattttgaccttttgatgacttgctgtttttctagatcaaagctatatggtttatgagcaatatattaataaagaattaactatctttaatttgttgagtaaataaactaaaacaagaatgagctatctgacaccagggtccttctttaggaacttcaattttg

SEQ ID NO: 1309 - DNA, 2668 bp, Homo sapiens
gggcgtggtggcgggcgcctgtagtcccagctactcaggaggctgaggcagaagaacccctggaacccgggaggcagaggttgcagtgagccgagatggcgccactgcactccagcctgggtgatagagagagactccgtctcaaaaaaaaaaaaaaaaaccataaaagcactatgacgtgaaaacagttcctacattaactccctgtcaaagtacttttaagcagatagctataagccttagagcattcttcattctgttattgaatttcttccatctggtcctgaaatatatatacattgctgacaaattcatgtgctataagctttgaaaaaccaaaaactttagtgggttctaaaatcagagctatttccaagagtcagtcacatcaaaagactggatttttcccaatttggagagaaaacagtgtctctagatttttaaagtggcatcttatgagcttagtcccatttcaacctcttttccaacccatgaacgagtattccactataaataacaattccattgtatgttattaccctctgtcctttagacaagctaagaactcttttctgacttggtggtttatttttatcccaaatgaatttatgttgtatatgctttatatttccagttttactaaaatgaggtaaacccagtagtgctagcttccctactatccagacaatgacaaacaccaatccgttcactggcaacgcactttacctctaatattctttgaacatttaaacatctaaattgtggagttgtaaagaccaaaggactttgtacaacatgcatacctgggcttggagacttgatgtttaccacagtcaagtttcatatctaagttgatgaaccaagtctaaaacctaatagagaagccaacttattagaagcatcttacctaagccactcacaacatgttaaatttgccacacatgggtagaggacaaaacttagaatcaagactctcatgaagattatagaatgcagccccaatacacacttgtgcatagctttttagtaggtaaatgtttcagcctgagagtctcaggtttccttttgacctcagaatagcacataatacgtgtaaatcatggtaggaattatacacctgagtttatttatcagtgacagcaatagcaaaggaaaccatggagcaggaaatcaaataaaattatagagctgacacatcaaaaccctgtgggaagctggaacctaagggaataattttactggcatggcttcttgcagagattatccagaagtcatgctgcagataaaatccaggctcttagcaataagagtatttctatttttatccctcatgggctctatgaggaaggccaagatgagctgagctcagctgcctataataatagctcacatataaagctgcttattatttccaaaatttggtttcagattggaaatctccatagaaaaaagcaatctgccctgattttctaggcctcttaaattatttcatccagttgatacataaggcctgtggctgactgggtaccaaacagttttaaaaccaaaatgaaatatggaagtttctcttaaacccaatcacctgttcatactcacagctccctccagagactgctgctctcttcacctgaggtccattattactttaatggatttaatttgctatcagagacaacatacagatccatctggggaccaacctcatagggtagtctgtgctactctgcaaaacgatgcttgatcagtacctagattcttccaccgtgaacaggaaataaactcatcattctgcgatttggcccttcctgcttcaggaggtggggccggagtataagccataataacaagtaacacacaaaaagaactcagtaggctaaggcgcttcataataaccaatgaggtaagcatgcatcttcctcatagcattcattcatctttatattcaagcaaaagttactgaaggcctatttatttgctgagtttaagatagctcactatggagtccaggcccctgtactccttctgctgaattactgcagtaacctcctaaaaagcaaaagttgtttttttctccttcatccaccattgttctttctcatctatccccactcaacattcagagtgatctttctaacacaaaaatctgattatgtgaaccccaagttaaaaccttccaagggcttcccaatgctcttaatataaaatccaaactgtcccatatgatctgacctctcccaaactctccagcctacttttatgccactttcccctttactctctatagtttggccatatttgactcctctcacttcctcacccctgtgttctcacagtacaatgtacatacgtttataacattgatcccactgtactgtattctctggtttgcctttcctcactagaatgtaagctcctcagaaggcagtgagaccatgctttatattacccttgcactcctagtttccggcagtgttgactcaaacatttgttgagtaactgagcaaataaagaaaaatagaaaagacaggagaaggaagaggtaggctaggggaagataattttgtttttaaacattaagttttaggtggcactggtttagtggaatagaaatgcacaagaacaatagagatcaggtctgcatgtattgacttggaagttatgtacatag

SEQ ID NO: 1310 - DNA, 7368 bp, Homo sapiens
gccctctgaacagggtcctgcctaccctctgcagaccaatatggtgataaggaagagatgggaagctctgtgcctaagaccttcataagcctgaattcccttggaatttccatcctcctggaaaaggtacccttgacagaggccactggtttgaactaccttctatcttgaagatacatagagggctttgtatcaacttctcaaccacagtctgtgatgctgtcctaaggctgtctcagatatctgcctccactaggaactggatctccttgcccttggcctgtatcttgagtgccctagaggaccaaggtcctcatgatctctgctggcaagatgttcaccccctcctttagctgcaccctggggcatctgggaggtcccccattcttgggaatgggtgctccccagagaccttacaccatcagagagtgtccctctatcacaggaggcgggctgattttaccttggcttgagtgtcagtgtgagttcaagtgctcaaagtgctttgattatctagccagacatacagctccaaacacaaccctcagacctgtgcccatctgaaagtccctttacatcaccaaagtcatgcagtcctttcctctctctcaaggtttcaacaaacataacttaattgtttctcactaatacaggacacattgctagttctctgcagtacattgcagctttgcaacttttcctttttaagtttttctactgctacttctgtgatgaggaaagttctgccttcagcagttgggagtaagatatcttctgtagtcaaatgttagtctcaatattttcccatcagcaaaaaagatggccatttggtttctacgttcttctaaggcacctatagtgtttcctattaaaatgttacttaattagtaaggggattttaagttcggaagttaactagaaccatttttttttaaaggtaagtgctttagcatgggccataatagcaggcaatctagcacgtttcctctgttaaagaagccttgcccaaaggcaacacaggctctccaagatccattttttagaaagccaggcaaatcacaaatttaggaagtgaaagggggaatcatacaaggtggacaagctaaggttgcgtgggtaagcgtggttagtcccaccacttagttcatccagttccatggcttgcagcaccatgccttcaaccatgggcagcacgtttaacatggtgccgagatccaaaaaccagaaagggaaaacagtcggagaatgctccctgtcttctcctccactctgggtcatacagaaacgaagaagactaaaaaaatgcttttattctcacttctttttctaaatgggtaataaattatcttcagtttacacccctctgaagtgcactctaaaacaccagaacttccttaacctgagaacgttaaagagaaaagcaactcattttcttttgcacaaggacagggcatttttaccaaacctttgcaagtgctgtaagatcaacccagctcttttagcaatcttatcagacagagccagggaaaaagttccccaaaattaaaaaagcaactttcaggggaaccatctaaaaatcccccttatttggggcccttttaagttcccttctcattatagaaccttaggcaaataaaggaaaacataggctgattttccgaagaccctaataggtatatagaagttttccaaaatttaactcatgtatttcacctcacatggaaggatgttatactgctcctaaaccagaccctaatggcagctaaaaagcaagcagctgtgcaagcaacagagaatttcagaggtgagcaatatatttcctataatacaccaaaagggaagaaagcaaataaggaaagcaaaaaaatagtagaaacaccattcccaactgggagggaagcagttccagtaaacaactctgactgaaaccccaaaaactcaggaaataaatgaaaaaagcactttttaatatgattttagaaggccatggaaaatgagggccaaacctcttaattactctaaactgtctataatagaccaaaagacagataagaatcctgtagcctttatgaaaaggctgagaaagacgctaatagaatacaaccccttacccctaattcaatcaagggatggctcattctaaaaaacaagtttattacacaggcagctcccaatattaaaaggaaactacaaaagcaagctataggaccaaatagcaccttagaaagtctcctaatggtgaccactttggtcttttataatagggaccagaaggaggcccaaaggaaaaagaaaaatctcaggagaaggacaaaggctctagcagcagctttgcaggcttgcaaagtccaggatccccgaggtgcatctgctagttgctatcagggtagcaggccagggaattttaaaaaggaaggcccaggcagcaagaaaaagccacctcaaccctgtccagcctgtggcagagaccactggagacagaactgcccccagaggtggaggtcactgggttcaggaccagtctcacagatggtccagcaggactgatgggtcccagggctcaagccctggctccagcagctcaaactgccattatagcacaagagccctgagtaatgctgaaaattaaagaagggaaagtaaacctccttctaaacactaaagccagtctctctcttttctcctctctaatccaggcctcccctcttcccatagcaagactgtaaggagtgtctcagaagaaactctaatccaatatttttctcaaccttggttgcagttaaaaggacctattatatacacatgcttccaagccactgtcataatagctctactaggcaaaaaaagcctccaagttaaccctaggaaataatttaactgtttacaccccacatactgtggcagaattactgtcctctagggaaagctcttagctaacagccagtaaaacaagaaatacaaaaggaggataagcagtagtcactctaaataacatctcttcccaggcacagcgctcaattcgctaagctaatagctcttacaagagcacttgaattaagcaaaggaaaggtagctaacatttatactaactccaagtatgctttcctaattttccatgctcatgttgccatttgaaaggaaagatattctcttaccactaatgactctcctataaaatatcaccagaaaatcaataggttattatcctcagtttttcttccacaagaaatagcaagaatgcattgcaggggacatcagaaagaaacaagtgaggtagccaaaggaaataaattggctaatcaggcagctaggtcaaaggcaaggaagcctcaaggcatcaacatgcttcaaactgcttctaatctaggaaggctccataaaagaaattaaacttcagtattccctacagaaataaaagaggccacttctcaagggcatactttccagccctcagaattgctatggtcaaataatggcaaactccatttgccaggctccagccaatggaaagtccttaaaatctttcaccaagcttttcacttgggaaaggataaaacttatcaatgtgctcagatattgttttcaggcagaaaacctctaaattggttaagcatgtaacctattacttccaacaaaaattgacacaactagcagaagcccaaccccagaaaacagagccacctttattcgacccaagacatttagtattagcaaaaactctcatctctctctccttccataagccaagctggaaagggccctacactgttctttcaacccctttggcaataaaagttacagaaaccaacttctggatacatcacattcaagtcaaagtctaaaaagctaagggagcaacccctgacagcccagaggaatgtcctaaacataaatgtgaagaaacagaaaatcttaagctaaaactcataaaaaataagtaactaagtaagggctattcatcttaatcccactcctacctaacctttcctctcaaagttcaccaccaaatattaaaacttctttttaactcatatttgcaagcaacttttaattatacatgggattgcatttgtaactttataaacccacaaagaagattacatcttggcaagtaaagaaataattttatatggaaattatttactatgccactcttgtggaaactgttatcatcccactactaattgcaataaaactatacactgtgtcacccacaatgtggaattctggttgtaaaattctaattgctgtaatattttgcctgattatcatccttataacaggattaataattgcaggaaagatttactcaaggttgttttggttatagcaaaagtaatagggataaaaagtaagtataaaagttttactatcactaagtttaatacgacttttttactaaaggttgataatacaatgcactttaagctaggaaaagactgttatttaaaaaagattttatataaggaaagattttgtatggtaaatacttgtcctaaaaaaaaaaaaacagcaacaacaacaactggttatttgaaggaaagatgtttagaacaagtcagaaagtttaagtatgttgtagtctgtggaagctataaaaaaattaataaattgtcaaattaatgctaaaattattttagccacccaataacatatctctcccgatcatattgcaagttataaaaatagcctaagcctaaaattcctctctaatggcaagtcaagggggaaatatatgcttttcctcaagaaaaatgttacttttatgttaacgtttctggtaatgtacagcgacatctagtaaaaacaaaacggtattgcaatccactggtgtaacaaacaggtgtcaaactctactgtcagttatggtctataggacccccactaatggtggtaatcttaatgcttatattctaactctgtattttaaactttcttgtaaaatttatcttttttcgcctaaaggtaaccaaactccaaacagtgctgcaaacaaagccaaacacagacacgctattcttccaaaaacccttaaatcaacctcaggagaaggcccaactgctgttcccccacacgacaccccttttcaacaggaagtagccagaaagaatcgtcatccaacaccccctaacagcagttaggtttacgtctctttaaagggggaataatacaggagttattaagaaataactttcaggctgatagtagtggtaaaggttctctgtgaaaattttcctgcaataaaaagcaaccgcccgaaacatttcttctctaacagaaaaggcggctgaagagccaggctggaaaactttgatatgcaaatgccagtgattaaaaactaggttcatctgacatgggcaatatggcgattcctaccacctgtgccaagtgtcatggccacctccggataacaccatgtgttcagaacatcatggcgacccacatttgcatattaaaggactaaggtgggagggccaggttttttgcggactgtgtgaatgacacacctggtcaaaccaatcctctgggcccatgcaaatcaaacatcgcctccttcagcctctgatataactgatcatttttccgctgctcatgcagtctctttgtttcaagcctccccacctctgtctctgtacaagggagctgttttcttctttcttgcctgttaaacttttcgctccttaaaaccacaccacatgtgtgcgtgtccttttatctaaattggcgcaagaccaaaaaccctggtgttcttccattcatcagagccatgtcatcactatctctaaatcacttttccatacccattatgtgtgaggaagaaacatggctcataaatccttttgcattcctacctttatttttgacctagatattcttttgtctttcccaaaggactgcttagttttcctcatcagagcaagaatacctcaaaagaaactttttatttcttttcttttttccttttttttttttttttttttgagacagagtctcgctctgttgcccaggctggaatgcagtggtgcgatctcagctcactgcaagctccgcctcctgggttcacgccattctcctgcctcggcctcccaagtatctgggactacaggcgcccatcaacacgctgggctaattttttttttttttttttgtatttttagtagagacggggtttcaccatgttagccaggatagtcttaacctcctgacctcattaactgcctgccttggcctcccaaagtgctgggattacaggcgtgagccaccgtgcccagccagaataaatactttcaagactgacaaactcactgaaatataaattcatagctctccctatattttcctcattctatcaacacatacaattccagccagtaactagcagctagcatttgcaattccttccctcagttatttttatcagggtagaaaacctgtgcaacctgaactcaatcactcttactgtcattttaaaaagcctaaacccactaaacagctcaccaagatgtcctggaaattgagtggggggaaagacaaaagggggaagaaaatttctgttggggcaaaggctcacaaattctgagattaacaggtcttgcatttcttccataaccctgcctcatgagatggctgcaggggctcaaagtccagccacagaggctgtgccccagcagagccccagctatgctctctctgctgccttgacactgtgtaagacactaaacctttgcacagcttttgggtatgtgtgaaaaaagggggatggaagagagagggaatacaaaatgaaactgaatttcctgccagccggaatagttctcccatgcctgagctggtagatgagattcagagcttctatgttactatcttggtctttagtctttccggagcctggcatcccttggcctctctaatgaagaccatattagcatgcacttgcttgagtacttttgaatctcttaaaaaaaatctcttccacttatgatattttacaatcaaattttcttcaaatttctttttaatatgaaaaatttcaaacgcacacaaaatcacagaaaatagttaaaaaaaatccatacatccatcatctagcttcagtgattatcaagactcttgtccttcccattttacctaataccccaactattttttttctagagtactttaaagcaggcctgagacattgttatcagtctacttgtacatacatctgtaagcatctttaacagataggacattttacaaatatagaaccctaatgcctttatcacacctaaaaaagaaataaaaattccttaaattaattaaaaacccagcctatattaaaatttcctttgatggtcttaaaacatgtcatgtatagctggtttc

SEQ ID NO: 1311 - DNA, 1356 bp, Homo sapiens
acaagtaaaaacgtaaacatttaaggtatacaaagtatacaatgttttgatatgttacactgttaaataattaaaactaagctaattaacacacccatcatcttacagttaccttttgtgtctgtgtgtgtgtgtgcatggcaggagcggtgagaacatttaaggtctactcttagcaaatttcaaatataaaatatattattattaattatagtcactatgctgtacactagatccccagaacattttcatcccacataattgaaactttgccctcttctaacatgtctgattaatcttcttaaaattctctatatttgttacaaaggatgaaactaagctcaaagaagttaaggatcttacttaacctcgcatctagtaagagacagggatagaatttcaaccagcatcttgatcccaaagcctatattctttccgattaccatattattccgtttccctcacagctacagacttctttcaataaaaggtgtttatccctacgcaatgtgttgtatacagcttgtaggcatttatttgcttattatttaagtctttccattagaacaaaagtggctttaggataagaacttggttttagcctaaaaccaagttcttatcctaaagccgcttttgttgtagataaggcctagcacatagaatatcctcttttttttttaaagaatgaataaatgaagtaagggaaagcaaatatcagttggttgctatgaaactattccctactgggatagctacatcctctattctcatgcttgcctgaccccacaaaaaagtcggtttatcatgcaataataaaaattccagataatttcaacacaccacaatggatcagaaaagtctatcatagataacttaacctattttattaattagtaagtttatgtattactaacggggaagtagaaataataagagttctgaagtcagactacttctgtttttatccaagattcccctacaagttgtagggtcttaagcaggtcccttaacctcagtgcctcaagttcttcatctatataataaggcagtaaaaatagacatctaatagggctgttgcattaaatgatagaataaaaatacttaacacatattaaatgctttataattgccatgattttagaaatacatggtcattttatttcagcaattgcagaagccacaaacaaaaacaaatattaagatggatgcccgtgaataattaacaatagatggatccacagttgtgctgtccaacacagtggtcactaaccacatgcagctattgagcacttgaaatgtggctaatccaagttaacatacgttttaagtttgaaataccagatttcaaacattcag

SEQ ID NO: 1312 - DNA, 2446 bp, Homo sapiens
gccctggagctcagaatcctcaggctgcgtgtagcccatgagggaggagccatggtggtgtgaggccaggagtcccggggagagaaagtcaagtgtgagagtcaccactccccacacccatggtgtccagcgcctcattattcctccactgacggcattacctgtgtgcccccgcccctccctggcacatactttggtgaaacttggtggcacgtctttctgacagccccacatcccaccaacattctgatctggggtgatgctccaagctgccatataaaattgaccctttgatcttgggggctacagggacagtcagtggaggtggtagggcctggctggctggatctcattcctcagctggaggtcctgccgtaacacacacttgttctggccagggctcttacggggttctcatgtgtgctgcttatactcaaggtgcgctatagttaggtgagggtaggaagagccagggaggggccatggggagaaatgttgagtcagttcaactccagaaacactagtttcccttggtcctcgtggggactcacagtttctacttgcagcgcctccggcttagccagaacaagcgcttacactgtctgaatcagaccctttatggtccagtaaactgtgcttcccttgactacatgcagccccttagggggcccaggaagtcaggaggggtgtggatgatgacttggtgtgaatctcttcatcatccccactcctggagaagctgtcctgcccccagcagagaagcacactctcaccatggtctctgattttatttttatccatcaagaagagaatgcccatctcacttatttcttgacctccaaggtgcttctggtagggtgcgatgtgtattcacagtgaacacaatcggcagagggcaagatgccagcccactcttttgtgaaagggtctgaaatcatctcacggtcttcacagttgccttggttacatctgcacccaaggataaaccctccttagttttccaattgaaattatgcctgagccttcccacttctgagttttttctctgccaaggctggttgagacaaaggtcagatcagtcaccaggcaggaaggcgctaccgcagcttgtctggttttgaccccaacttggtgtttctctcggtatcacatctgccaagttcctgaggtgtgacctggatagggctgggaccagggtgaggcaagccacgcgccaagggtgcagatttgaaggaggcactcacagagtgcgcacacattggcatgttctattttcatctgtagctgtccactcagcaccagcccttgcaccagtagccagaaaaagctctccacaggttcctcccactccccctgagttataaaaattgcaccttggcctcaggattgtgggttctgcttctccatccacctttcctgttgaatagtgaagtctcttgagcacctgttatccatccatttaggcttcctccaagcagggattaagacccagatagtgccaagcacagtgttgggtccagtgagtgccaaggtcatctctctgggctctcgaggaggcagcagatgcatgctatctataacaagccacagcagtgggtggtgccctgggactttaagggacagaggccctggcccaggtggctgggaagtttcccagaggaaaggagaagagctggggctagcagatggtgggaaggcatcgcttatctctgggcagcttgaggagtctcctggtctccgagggtggatgcagcagagcccagggcttgggaaagccaccagggaagtattggtggctgagactcctccgcagcgacctcatctccctcctcttgctggtggacaggattagtagcgaaggcgggcagtggagagaagggctcccgtgactgcctccattttatttattggtttgattatttttgcgtcctggggagagagtggaccccgttttttgcattagcccatattgggaagcaatggggatgggctagaaagctggtgcctcaagagtggttattgatgtcctaattacaagaggatgctaatttaatttgaacctaattacagtgcactaccctgggtggcatgtgttttaataattaacgtccttcagatgcgtaggagtgtaataatatttacactaggttggccagcagcctgtggaggcggactgggggcccatacaccaccttctccctggacagcttggctgtgagcaggtggggaagaaggcacatgggtcctggctggcgagtatcttgtcatccttcccatgtaacatgcttgggcctcatttccagccacttccttgacccagcaggcagctttgctctgtggggcaccaggctggaactctggaatacatcaagactggcaggatcaggtctctgggctccagccccaaacccacctccccaaccccagtctaccacacagggatgtt

SEQ ID NO: 1313 - DNA, 2229 bp, Homo sapiens
aagagaggtcagcaaaaggaaaaaaaaaaaaggacaaaatggcacagaggtgagtctctgccgtctggaggtccttggaggaagatctgcttattgttgctagctccctgggagctgctggaattgggaggagtcactttaccactttgatctcaattcctcccatgtaaaatgcgaagatttggttggaatagtgattccaacttggattgtgcgttggaatcacctgggaagagtttaaaaccacgcatgccttggccctacacacaaagattctaaactaattggcttgggtgtgaagtctggacatgagatgatttttctttctccaggtagtgacgtgctggtaaacctaaacacactctcaaaataaaaagagatctgatttgtaacatttgaccatttccatagtgtaaatattcccactctggcctatttcaagcagccaacaagtgtaacaactggcataccgctgtctctcgggaattctaaagagaactgctacatcagctacttcaggaaaacgcatttacctgggaccatggagcgtcaagtcctcggagtagaggtgagaagaaagggtctggtcataactcccatgagaatgccccccaacaaccccctttcctctcatcccattctccccaccaaaggcactcacagtggtttgcggagataaagggcaaagaaggaatgaaagtcccagtggcctccaaatgctgtcaaggccacttccaggaaacaacctcttagctgttcatctccctttctttcccatctggaaaatctctttaacactgaaagcagttagccagtcatctgaaaggtcaatttttcacacattatccactttcatcagcagtaagatcaagaactgttttcccagaagacattcagaacttctgttagagccagggtgggaagagaaggggcagagggagggaccaatgggaagaaggaagacatccgctcctcctaagcaatggcgaggtttccgacgtttcacctggggccaggtctcggcctctcttcgtcctctcctccgaggctgatcctcttgtattcaactaaatttagtagtatttgttaagtacattcacaaattcagctctgtgctattttgagaatttggttttttgtttttatttttatttatttatttatttttgagacggagtcttactctgttgcccaggctggagtgcactggcgcgatctcggttcactgcaacctctgcctcccaggttcaagcgattctcctgccttagccctctgagtagctgggactacaggtgcttgccaccatgcctggctaattttttgtatttttagtagagacagggtatcaccgtgttagccaggatggtctcgatctcccgacctcgtgatccgcccgcctcatctgggattacaggcggtgagccactgcgcccagcctagagaatctggttttttaattggaaacaactgtcctttgggacattaacaactagtaggagagtctttaagtcaagactcaagggagaaaccaacaagctgaggaactctaagtcgtgtgtaaatcagtattggattggtgcaaaagtaattgcggtttttgccatgaaggtagtggcaaaaacctcaactgcttttgcaccagcctaatatgacagttgggtacgggctgcatatatgagtgttggtgaaatccaggatatgtttataaatgtatttttttatatcccaccaatttccaaaaaggagtgtaagtgatgagacccagaaaaggaccaaagccagtacagattcacactgcaagtcctcatggatgggagacttgtcctgatacatcaggccattgagtgatcccccgggtaaggcaagtccaggtctactgggcctctaggaagtaactttctcaggcagatggccctcagtttgggcagacggctctggcagggccataaacttgtcaagtttttaacaatgggtgggtatgcctccacttagaggggacacctttggctaatgtgctcaaacacattcaactggcaagcaagagacccagaatgagtccatcctgccaacgtcacagagccaagctgggcctccccagcattcattcagacctgaggcccaggttctagtccccactctgcaataaacaagatttactgctaagattcatggatgccctaaaggagaacgggagcatgaacttggataataaacaaaataatcaataa

SEQ ID NO: 1314 - DNA, 2798 bp, Homo sapiens
attcaagggcttttgacttcccttaaaaccacattttattttcagggctgacttaaaatgtttcagcaaaacatggggttatgttcccctttcctattctcttccaattaaaaaaaaataaaaacaacatatatttttacttgaaataagtgttttttcacccacatcaaccatttctcttcatcacacaacgtggaacatttgaaaggtattttttaagcaatattcaaactgggtttgtaaaagtttgaactatggtttcaaaatgattgaagctgaatgatgaaaaattgtcaataaccaatatgggatcattaaataaatctataaaatctgagttatagctatgcacaaaaattgtgatatatatttattcccatgagaagttgtttattctgtctgtatactacaaagccatttgtttaaaaaaagtacataagtgtacatacacattcacacacatgcacacatatgcaatatgcccattttttgaaagaagttacctgtggaatgtggggcatttaaaaattacttttcaaaattttctacattttataaatgctatattttatactacatgtttattatcagaaaaatggcactaaagccattttcatttcacaaaataatttgattgaaactgtgcctcagtctagttgtatcaaagcaacattattattattaaacatccaagagtctttatgaaagttgagaattaaatgtagagcaaggctcacatcttcatcaaatcactctttgttcacatgaaggcagctgggcacctgtacctcacaggttgggcatctacagctttactgaccgctgcctacgggtctctcattgtccttgaccaccagttttgacttgagtatcaagtgccagttgacatccccaacggcatcccagatgtggtcagacactcagagtacccaagtgagcctgaggcaacacttatgtcctctgacgtaagcgctgactccattttttcaaagctcctactgaagtaagttaagggaaattgtcttactttactttctccttcatatactatgaaaatgccatactctgaattgagtgtcccatctgaattgctgaaacataaatttctagccagaggcagtgaaatttgaatgactgcgggttcttttgacatacttgagaagtagatgtaacttggctagggtttcaaccactcacctttattggaattagatcctttggcatcctcctctaataacccaatggcattcagtctctgtgttcccttgtgtctgcagaataaaactaggattctgataaagtatgagaaaccgtcagtctttgcctgccctgaaccaataaaaatgcacatgaattttgccactttatgttcattgccactgatgtaaaatatggtcataccttgtcattggtgggggattggttccaggagccctgtggaaaccaaaatccatgaatgttcaagtccctgatataaaccagtgtagtatttgcatataacccacacacatcatctgcatactttaatcatttctagattatttataatactgataggatttggctctgtgtccccacacaaatctcaccttgaattgtagtaattcccatgtcacgggagggacctggtgggaggtaagtgaatcatggggaagggtttttcctgtactgttctcatggtagtgaataagtctcatgagatctgatagttttataaaggagagttcccctgaatacaccctcttgcctgccaccatgtaagacgtccctttgctcttccttcgtcttctgccataattgtgaggcctctccagccatgtggaactgtgagtccattaaacctctttcctttataaattacccagtctcaggtaagtctttattagcagcatgagaacagactaatacaaatgcctcatacaatgtgaatgccatgtaaatggctgctatactgtattgtttagggaataatgacaagaacaaaagtctgtacatgttcagtacagatgcaaccatctgtttttctctcctgaatattttcaattcaggtttggctgaatccacacatgtgggacgcacagaaaaggagggctgactgtattccatttagggtcaagtgggtgggtgagttttggcatgttggtgaggtcgttttccaaaaggaaaaaaaagtaatcaaaatgtgaaataacacagtattttagaaacttgaaaaagaaaataactgaatctttagtcctaacactctatcagaatttttaatttctaattaccttctatcctttacccacatgcatattcattcatttttacatagttgccatctcatgacacttaccattttgcattcttatcaaaatgtaataagccacaaggctttcctttcctcaaaccactcctggtcttctaaattggttaacataagttgggtcttgtgatggagctgaacacctgaattggcttaggcctaaaactgctcaacagtgaagttgagagatgaaagagaaaaggtagaatccataaatagatggagtgaaactacctcctacttcctgactgacgggatgagacacaggtgattgaagctagtgtgcgcgcataaggggtagccatccttccacctcccaagcagtataactatactgaggaagaatttaaaaagcaaacacccctaaatacctttagaagttattcctcatgtgattgataaagtttctgggctagcatacttgaaatgctagtaattagagtggagttacttgtgcagggtgctgaggaagacagaaatattttatctt

SEQ ID NO: 1315 - DNA, 1267 bp, Homo sapiens
tagattgtagagagtatatacgccatgctatcaagtctgaatgtaagggaggaagggagaattataaaatgtagaggagaatgaaagagaaatttcatttcaataagggccacaggaccctgctatgctgcatcttaccacatactttcgaacaaataaggggggcggggaatagtaacaagagctactgaggaagagatttaaacttcatcaaaaggtcttctttgtttacagcctgctagttgccctacccagaccctgtttcatagtagatgagggcattataaacagatagattccaaattttctgagctacaatttggtttagctttcagtaccaaggcctaattacttaagcatacttctctcaataaaatttatttattgagccttcaatcactcagtaaatatatactgatacatgtgcttggcactgttagggctcagactacaaccacacataagacaaacacaattcctactctttgaagatcacataaatgcagtctggaacacaaaggttcctcctgcatggataaaatattcttatttactgtcacctgagcaagtacagttactagacaaaataaaccttaggaaaagtaatgaaaagaacaattttccaaacatatttccttaccaaaatgttagctttaatttttgaaagtatactgatccctccatgacagattataaactatcacttcaccacatctatcaatagcttttccttttgttaagtacaaaacatctacttattccatctgtccctatcctcaaagctgcaatctaccaaggcccctggctcattttacctactgcccttgctgcattcaatatgaacttcaattactcttttaacactgccatagatttctctaaacctctcacctctaaaagcatttatttccattctacctttaagacccggagaagcatcacagtctttacaaaagcaataaaaatgatgaaatgatctcgatttagaacctcacgcacccctggggcacacatacttatcccaacttcttaaatgtctatctcattacattaatctgttcaaggtcaacattaatctctcaaacagttgctaagatttggccattgttgtcttccttcacatactttgcggctcacaactacaacaatgccattggtgatatcttaagattttcaggctaattcttgttattttatcaactagcttgccagatacaaattttgggtaagtctgaccattcaattgttctattttttcctgtcaggt

SEQ ID NO: 1316 - DNA, 3846 bp, Homo sapiens
ctttaggctgggagtgcggtctcaattatcctaggctttaattgatcacactcctgattagatcacctcttccatgagtgctctgtcttcttttttcttagtttatttcttctttttgttgcagtacatcctgtagtagcctctttaaaaagggtgtgcatttttgagtcctgtttgcctgaaaatgctcttattctctcagtcttgcctgacggtttgattgggaagagagttcgaaattaattatgcctcagtttgaaagcacaaatctctgggtaatgagagatgcgatgactcttagattgtttctttttatgagacctgatcttttcctccccatgaacctggtatcattgtcttaggctttccttgggtctctggagatgaatctcccttctttttagcaccccctttttgacttgctgagcttgttaactttctttgctctcttcagtcagctactctcacctgttctcttccttccaaaagtttgttgcaatctttcatctgttgaagtctcctttcccattctttgtctttgtgggttgcaggcatttcccccacttaaaccctttccttccattggtagatttcgtgagggtaggagaaaaacaagtgttattggatttgctctgtccaattagaagtctgttattattagaaataaatgaaaatggcctgaatatttcactggaaaactggaacataatatattcaaggtcttctatttaataaataaataagacttttgctggataagcaaagagagaacagtgaaaaggaaaaaaggaatggaaaaaggaagggagagagctcagtagaaaaaatatgccttgaggagggacttcataaagacttttcaaaaggggaaaaaagcggaaatctaggccagttctgtctaatgcaggctattcagacactgtagattagggaattattattgataatggatttatcaatggacaattattgtagcatctttttcaagggctgtcacatgtaagaattttatgcttgtcagtctcagagcgtcttaaggacacaagattgtgaaacaaagggatgttgattctgcaaaacaaattccatcctgtcctaggaatggtggttcacctctatcagagagagaccaccagcatcgtgggagatgaaatgctgggtccagggacatctccatgtactgtgtggagactgtgggcctaactttaaatatgattacacaaatgtaatattatttatggtatgggaggaaccataatatcatgatggtatgggaggaaattatggataagggctttttcctttttcatcttgcctattatttttcttctttctttcccacttttcttctttgtaaatctgaaggctctgaatgaaagataaccataatagcttgtttgtttgtatagctatgaagataaccattacagcttgtttgcttccatagccaaacattatttcctgcccacttgcaggcggatcaaggctactggtcagaaaaagaagaaaaacattctcaaagctggaaattccagttgtggtcagccaagagcctctgtctgaatttcagtccagttctacactctgtgttatgcctgacattctgaggctgcttctgcttcttctcctttaattatttttattgccgtctcttgctttaaggctcttctgagtgtcctgcatgttgccttagcctgtcttttctctgtctcttgatgctgtatcaaggatacacaggaaaatagaaattatgcccaccttgtgggaaaagagacttttggaatcagataaggctgggaagacaacactgagctttaatggactgggtgttcaggtggcctgggagtctctccctttatatcttcaggcctagtgccaagactggtggtgtcactgtctgtcattgtgaagattctctgaggtctgcgtggctttccatgtcctgcagtagatgtaggaaacaacaggaacaagagtgtcttctcctctcctcctcatcacattatcccctgaagctcctggaggagttcacaggctgaagtgtttgcattcatgcagaggagatggcagctgttagtggctgtgcacctgcctcagacccagggacatggagtctaattccagtgtctgtactggtgaccactgtgaactcaggcagaccttgacctcagtgggctttggcttccttcattggtagtgggggagctagagattgctgcagccctttgaactagaacatactctgaggctcttggctgatatacatgctaggatggcatactgcttacttctcctttcttagagtcatataaatagttaggttaggttttttttttgagacagagtctcaatctgtaacccaggctggagtgcagttgcatgatctaggctcactgcagccttgacctcctgggctcaagtgatccatccacctcagcttcctgagtagctgggaccacaggcgcacaacaccaagcctggctattttttttgtattctttgtggagacaaggtttcgccatgttgcccaggctggtctcaaacttctgggcttaagaaatctgccctcatcggcctcccaaagtgctggtattacaggtgtgaaacaccatcccaggcctgaacactctgtttttaaaggtttcaaacaggctgggtgcggtggctcacacctgtaatcccagtactttgggaggccgaggtgggcagatcacctgaggtcaggagttgaagaccagcctgtccaacatggccaaaccctgtctctactaaaaatacaaaaattagtcaggcgtggtggtgtgggcctgcaatcccagctactcgggaggctgaggcaggagaacagctggaatctgggaggcagaggttgcagtgagccaagatcatgccactgcactccagcctgggtgacagagtgagactctgactaaaaaaaaaatagaaaaaaaagtttcaaataaatgtgaacttctgcctcaatggacacaggttagtctatctggtaatgaatatcaaacattaagaagtgatgatttttcttgtgtctccttctgcctccttttactattggcaagcatggttgcctcgactgtaagctctctgagggcgggactcctggttgtcttattttcgagatcccttcagagtatctacttgtccacattcctgaaagtgaaaaagttggtcacattttatttattttgtttccccagcacctagcagagtgtcaggaatgtataataataaatatttgttgactccaatgcctaacatatggtattctaagcatgcattgtaaatgtttgaaattgcaacataagcaaggtagggatatgagtattatattttattttttctaaaaaaacatacactgtgtgaaataaaaacctttcagaaaaagattacacggcggttttctttctcattacccatcactttcctcctccctagaatttcaagacttattttctcaccaaacagaatcaaaagacaaaattgtaagaaagcttccagaattacctgggctacctaatatccccctttattctatcctttttgtactttggtttgttggaagttaactaaagataaaagaaatatctgaggccccctattggggtgttaattaattgtttcttgtccaaggaataaaaaaaatgcttcaagagaatgtctgtgtttgaattagcagacaatctctctcctatctcaacctcagttttcttagttgacattctcaagtgtctccaattagcttaaggagtgttaagacattaacaaaaattcccaaggcaaaattaatttcaatttgctttggcttaaacagatatgccatacatcacc

SEQ ID NO: 1317 - DNA, 2469 bp, Homo sapiens
cacgtggtagacatggcctggctatcatattgtttgaagacagagatgctggcttctcaagacccttccaagcttgggtcatttgctgtccatgcgagcctgtccaacctcggggagaatcacacttaccactggtctccacagacaagaggaccctaagtcttcccaaagcagtgccctggacagactgcatagaggatgtgtgaccctgagccagcactagaaagaagaatgtggagagtcctccagagtttgttgtgttggtatttggcttgtctataattaatctgtacagaacattgcttaaaataatcaggccaacgttagagactgaggatacttttacagttctgggacttttaatgacatttattcaaatttgaattacaaataatctagactagaaagttaggggagttcttggaggttatatattaaatgtaactgtaagaaagtccttgactcgcttgtttactacaattatatcctttcctttttctgaggatccttgggagaagtctcttttgggtctagtctcagtaataattgcacttcttttctttattcctttctacctttctgttttttcgccctccttccatccacctccccttatatcctgttttcttcttacctgcttttataaatttcatagatggtgtgaaatgaataattgatcacaattcccttttgttgttgcctgataatttggctctaagaacatttagagccaaattagtggttcatcttcagcaagtgaatagaacttattttaacaagtggataggactctatactgcacattttattattggtcttatttatggctcaatttttatgtctctcatatcctttgtttttctttctcatatattcataatttgtagtgacttggtggatttttggtgtccctttaatcaaccctcaaccctttttggaatgatataggtcataaaaactagcagcgtagttgtccctcttaaaatatagaaatgaggttatgtagcacaatttatgaaccccagtggctttcagtaatcaacatctcttccatatactcaggagccaccagtttcataattaattccattgtgggctttagcttgggcttttgaggatgtgccttccccctctcctcccaccagatctagacaaaatctgagccttttcaggtctctggcatctctttgaaaatgtccccagacatggacctgtgagccccaccttcagtgctgggcagtgctttatcggggcctgaatagttgaactcatttaaagaagccaactgttctcctattatcctttcactctcttgtgcttcacttatttctttatggtgtttattctaccttgcttcctctcaagatcattttcctaaggaaaggcaaacaaactaagagttttgccttcttattgccatctgtgagcattaaattatcttctctgagcagtggattcatcatttcttgcttgtttttttcccccccaatacgtagctcaaaaattcttttaaaaatgttctagcactttttgagcctgcagccctgctgacagatgccctgacccctgtggcagagctgtgtgcccgtgcggttggggacccctcctccccacatttgtccctgtcacttcaatgctccaactctggcagacagctggtgactgtgtggccctctttagatgcctctactctttttttttttccccctctgggattgtttgtgattgtcgcgctgaaacttgacctttcatgatctttcttgcttgaagggcttaccctgttggcctgcctagccatgggattctacctatttttctccccaataatgttttccattcatttttttctcaagtccaggtgcctacccagtgcctcgctccatcctttattcctcatctgttgcagcttcagtttttcctgctggctccttagcttctacctacaaagataagcagagcatccctgtccggaaaaaaatgaaaaaaaaaaaagatttaaaataagaaaagaaaaaatgatagaaagaaaaaccctctttgattgtgttatcccctctggcatctctcttacatcttccttttgcatttgcacccacattccttgacagtcccgctgccctatcatttgctcccacccactctttccttggtcctttgcagacggactgctggtctcctgatgctttgaaactatgagctccagtgcggttgtccgaagagccgttcccacacaggcagcgaataccaggctctacagtaaagagtgacgttcctcactgtgtgctggttgactgcatttcttggcttgttccttaccttgcgttctgctccagtgctttttcttaccttgctgctgacctagcagttcattcaacctctctgtcctcacctgccctatcagactgacaggttctcatccctctgggctaacagccttggctttcctcccagttttgttttcatttcttt

SEQ ID NO: 1318 - DNA, 3773 bp, Homo sapiens
gttttccctcccaaagaaaataaacgctatgcaagggtcacgacaaatttgtttcaaggaattttgcttttcaaatccatgctgactccctgacttggttgcctgttagaccaaaggatacatttccttgtgtttaaggcctctttgtttctgaaggtttaaaaacgtgcatgtctggtctgtatgtgctcagggatcatttgctttggggaggggcttctttgcattcttggcatttcgacctctttgtcttcccagctgccctttcttgtctgtctttggatttcttcttatcctctttatggggccattttgtttagttttctataacttttctttaacggccatttccctctctacttttctgccccattttccttctgcttttcttcttcacttctgcttcctttccagaatgtagatgtccctcccctctcccactcacgtcctttccttcatccgatttggatgggctccttggctaacctctggttaatttcattctaggggctgctcaggctctccggcccacagtataccctgcaactcttctgtgacagtttataatctgttttatggacctgaaaactattcaatctcctggctccctaaaggagactgctgatgctaaattgaatgtggagggtctgggtggtggagctgctccttgatggacagctgcttatttatgtccctccgttgtttgttgagggattgtgctgctgccattcagggggagccacatgacagcaggggggaggggtggggggggcaggggtgggtggccagggcctgtgaagacagcaccagcccagtggaccagcagagggaggaagggactctttctgtccttctcgaaaggtaggaatttcttttacaaaccaattatttgataacagggtgggaaggtactccattcactggttcagcaattaccttttttttttttcttttgagactaaatctcattctgttacccaggcttgagtgcagtgacatgatctcgattcactgtaacctctgcctcctgggttcaagctcaagcgattcttgtgcctcagcctcttgagtacctgggattacaggcatgtgccactacacctggctaatttttgtatttttagtagagatggggtttcgccctgttagccaggctggtctggaactccagacctcatgtgatctgcctgccttggcctcccaaagtgctggcataagccactgcgcccagctgacaattaccctttgagctcctgttaggacccaggcatgatgctgggtcctgggagtataatgtgagataaaacattttcttaaaactgcaagatcttattggtcaatacacaaataattatagaaacaaggtataatttcaggctatgctgaacactgtggagtataacccgacctcctctcttgggaagcagagggaggagactgaggggtttcctatgggacagggaccttgagctgagagctgagaggtggttaaccaagggaaggtggagaggatggggttccaagcagaggaaagcacgaatgcaaagacctttagagcaggtcgaccttggagcgtctgaagctctgaagacaggacttgggagctggagagcataaaggctgaaaggcccaagacccaagagaaggaggcagaggccatgcttattctggaagagcaggcacatgttgaaaaatacaaaaaggggccaggcacagtagctcacgcctgtaatcccagcactttgggaggccaaagtgggcagatcacttaaggtcaggagttcaagaccagcctggccaacatggtgaaaccccatctgcactaacaatacaaaaatcagcagggcatggtagtgtgtgcctgtaatctcagctactcaggaggctgaggtgggagaattgcttgaacctggggggtggaggttgcagtgagccaagattgtgccactgcactccagcctgggcgatagagtgagactctgcttcaaaaaggaaaaatgatctgaaaccctgctagtcactcttctgaactgatatcatactattttgcatgttttaaacttctctgagctgtaaggtataaagtgcataaagtgtatttatcataagtgtacacctcattggatttttacatgaacaggttctatgcctatatacttgggattccattttttaatgtaacattatatcacaaaaattttgcactgttaaaagtacttcaagaatatgaaacataaagactgaatacaattctactacagggggcttcttatccatgctcagtgtgtacatttcttttgtgttgatttttcccgatggatctgtgcactgaacattattgtggataaatgttgatgcatatctggttatcatagaaatcctggaagtaaaagaggcatataggtgaggctcttgatacatattgttagattgctgaaaaattccttttttacttcagaatttccaatggtatgaaaacattcccggatcccctctgtgtggttgtctcttcaactgggtctctcactagaggaccatgccgctcctgctttgctcccttacatctgagtctgaacaaagaaaaattctcaaggaaggggttgttagtgagtgtttgacttggtgggaaagactgacatgtgggccgtgggcccctcctgtagatggggcccactctaagaacaaagtatggggctcttgctcacccccctttcccagtagacttgtcagtagaagaggtttgcaagccatggaaagaagtaaacatcccttcagcctcaactgggcttctcaactgttcctctggtatttctttccccagtggacccacccattccccataaggtacaaatattcagtatttgtttgtatttgttgaattaataaagatgtagtttcttaagtgatactacctagtataatttcctctcattattattcttttccagtctcatctctctttctctctgtctctccgcgccgacgtgtgtgtgtgtgtgtgtgtgtgtgtgtgtgtgtgtgtgtgtatgtgtgtgtgtttatgtagaggagaaagaaaataaatatcaccatagagaaggtaaaattctgttgatctctttggctctgcctttctctcaaagcagcaactccttgcagggtttctgggcttctccagctgtttaaaatggctggcctcctgtgtgcttccttgtttgtatgtctgagcaaagtggaaaattcaaaggaaggtgttttgctttttccctgagcaagaatgccgagcagggaagcacctccaccccgcgttcctaatggagcttgctctctgcagactggctgtgagcccaggtttacagaagttcacttcagacaaatacattctgccactttcactcttgggaacagacatggcagaatcccagtgggtcattccttctgtcccctggagccgggattacttcctaccttatagccacaatgactttttcaacacaacttttaaataagccataaaatggaaatatgcctggcaagtggggaaatattctattgcttgaaaaggcccatagaatcaaacagcttggagagaaacaaataaagagaacaatataaaagcaacaacaaggaaaaaattgctgcttattttgtttctctttttctcagtacaaggccaacctagtccttagtcctcccaaataacaatgggttccatgtaggttttgaactcacaggcctgaggcaaggggggcctgccccaggtaggagggtcctggctccagtggaaccgggag

SEQ ID NO: 1319 - DNA, 3769 bp, Homo sapiens
aacaatgagagaaaaggccagggggcaaaacagcagccacgccactgaaggtcttgacttgcatatcagaagagctgggatctccttctagaagcagtggggagccactgaaggagttcaaggtgtggaatagcaagatcaggtgtgcattggggaaagatgcagagactcgatgcacgtactgtcagctggaattaggccaccccatgtcactatcatgtgagaggacaaagggcctgtgggagaaatgggcaatgccactgcagatggctggcaagaggagagaagaaaaactgttcccagatgcattttatttgggactcttgctaactgcattttagacctttaaaaaaaaggtcaccagagagctattgagtgtctcaggaagaacaagggaatgtttgttttgattctactttgctgtgtgaccttgagcaagttacttaatctttctgtgctgctgtttcctcatctgtataatgaggatggcagtgagttgtgaggattacgtgggatagtataagtaaattgccaccaagtgtattgtaagtgctccacacatatttggtatttttattaatttattttagttggcatcctttcctttcctgggagagatgatatggttgaatatttttgtttcatctctggtctctgtaattagcctgctttcttcaagaaagagaacagcaagagttcctccagtacgcaaacacaagtgcttgtcctttttgactgtctttgtctttttttttttttagaagtaatttcatggctcatgcacttgatattccatcaggaaagctgggcccctctatcaagcagatgatcgtccctgctgggcattcattggcaaatcacaattctgttaattaacacaaagtgggattccagctctcaactcctttcaaactcaccctttcttccttgggttttgagttgcagcctctctcctctgctgagccccgggtgacatatgtatcttggagccatctctttgtctttgcttagccctgggctcagcagccgccaggccatgggccgcctgtctcctccacctccacctgccttgcacatccttgctctgtgcctgcctttttatctcaacatccccatcacctgtttcctggaaaatttcccgatttctccccagtgtaaaaaggggcatgtgtttctattccgagcactttgctttgacttggcatgccttcatggacttcagcggggagtctgggtctgcgtaatgagcctctcagcatcgcagctgccagcctagaggagcactgctttgctaatgcagatgtaacaaatcccaccaaacaaaactccctgaacagacgccttcacaagtcagggctccgagctctgccttttgttatcactttggctacttcccttgagactgtgtccttggtccttttcttttcttttcttctgttttttttcttttcttttattttccctccctccctcccccacctctgtctttctttttttctttctctccttccttccttccctccttccttccttccttcctttctctctctctctccttccttcttttcttttcttttctttcccaggtcagggtaatgggttgtaataatccacctacatcctctggcctggtacctgtcacccgagacctagaaatcgcagcctcagaggtgcggtgacttataaagtcctcagcggagccaggtcctaacccaaacctcctcacctcttttttggcacaaactctgaaagaactttgaaaggttgagaggactgtgtatatcatgcaatctcttgttgctgttgccatgacgatcgtattaaaagtggacccccatgggcactggattgtaacttgaaaatgatgaagataatcaattgtactacagtgttgtaaaaggcctgaaattccgatgcatgctacaacatagatgaacctggagaacatgctaagtaaaattaatcagatacaaaataacaaatgttgtatggttccatgcatttaaggcatatgagtggttgaatgcatagagaaattagaatggtgttcatgatgattgccattttactcgaataaaataaaaaaagaaaaatttttaaaaagaaattagaatggtggaggctaggggctgaggatgagatggagagttaatgcctaatatgagtggttgaatgcgtagagaaattagaatggtgttcatgatgattgccattttactcgaataaaataaaaaaagaaaaattttaaaaaagaaattagaatggtggaggctaggggttgaggagaagatggagagttaatgcctaatggggacagaattttagttcgggaagatgaacagttctggaaatgggtggtggtgatggttgcgcaacagtatgaatgtgtttcatgccatcaaactgtatattttttaatggttaaaatggtaaattttatgttatgtataaacataatttttaaagggggaggaaggaaccaccatgaaaacatttttaaagccccaaatgagcatttgtaaaaaaccaaaaaatgtaaaaataactttttaaaagctccctttattgactcaaagtcattctcttagctttaggatataaaaaatggattatgtataatttgggttgttcacaaaaatcatcgtgtttgtttggcgcattcaatttaaaagtataactcaactcacccattcattcagcacatttatggagatggtgtgggaggcagagtgctcagcctgaaataaaacaatcagcgcaaactcgctaattgaacttcatttaaaacggttgacatttttcttacaaataggttgacaagctgctgaacctaaggaatccagcatcttttgattcttgtgggttgtattggtgagtctgtttcaggttactgggaggaggcaggtctggcttgtctttagtgacaggcttttgttgcaaggatgcgagggaatgaagggtgcagggaaaccgtattctccctgggtcccagggcttcccaggttggactctgcagaaactgtgactcagtgttgtttgggtttcaggctgagcttgaataagctgccctttcagtatgcccttcatagtcctgtatccccaaagagcatctgattgtgtcagcttgtctttgttcagtaagaagtgaccacatagggcagggcgtccctccacgccatctctgaagcataaggtcattacgacaattaaacgagttaaatggagagtccttagaacagtgttttattcaacacatggtgagtggtgaatcaatgttgtcattcttatgaaacaagacacaacgcaagaccctaggatgagagtgggagagtgcaggaacgaagtgtaaaatctaaccaacgtttgaatattctgattcaacctcatccagatataaattgttcaagagcctgctctaaaggtgatctgggctttagagtggaggcaagttcagaagagaagcagcatgaccatctcttaggtttctgccttgggatcatgggcccaagagagttgcaccagcctgaattggttgacaacacaattcatgatgtatattgacaaaaaaaattccacttatacatttagattctgcaaaatgttgagttttatttgatctgaaccatttgctagagagtatttggatagattcagatgagggaaggaaaagaaaatggctttgccagcgacgtgcagtgctcagcggagctcgggggagtcaggctcacccagtgctcagtgccccacatagatcacctttgtggagcac

SEQ ID NO: 1320 - DNA, 2202 bp, Homo sapiens
cagagcaatcagccactcgaaccatagagagttatcacaaagtgggacagaaaggccccgtggccttagctttcacccaggctcaggttgctcacccaggctcaggttgcaggcatctataaccgagcaccgacaggagcctgagggttaaaatggggctacaagtgagaagggtggggggacaacatcagcagtgcctggagctggccaggcctggatgtggagcaggtacagcaggaagaggcagcaagaatgaagaaggtaaatttggagacaagagttcaagagatgaaattgcaggtgacttcagaggaaactgccaaggccaacatgaaaatggaagaattctatccccaacctctcctctcttccaatatgaaggaagatggcctgcgctgggcacttttctgttccaggtttaactatttcctggtcaaagtaggggcaccctgcaccctgggaaagaattagcaacaaattgtttaatgaacgctcagccccgaggagatgattaattaagtagggcagctttgctcaaccaggaggccgggggtggcaagtgggatccagttttccctttggcagggccttcaggggagaatctcgcccagactggcacaacaccatttgtgtgcctgatgaatcaccagtgacattcagaagctcaggaacaggatgccaccagggaaagactgcaggcaagggagcacgtgactgctatgagttcctgtgattcccttgctgggtgcacctcagtactgcttcgtggatacggatccccaagatgagcataaacatcaacgtatgccctaccccatcaagacccctctcacacaccctcccacactccctggaagacatccatcacctcctccccgaatcaggtctaaggctccatgatcttttgtctaggctaatgctggagcctcctctctaaacgccctgactccactctggccaccctgcaatcagtccttcacagagcagttagcataattttacttaaaaccataaatcagatatgtcagtcatccactgtcaatggcccaatagcttccagttgaacttaaaatctgaactccttacacctctttagaagctgtttgtaatcaggctcatgctgcctctcacctccttttctgttcctttccctaaagtcgggtcactcctaccacactggctgcctttctaccctggaacacccaaagttttacttcaaggccctggagtgatctgactgctttgcacatagtgtttccttgtaatcccttgtggatggctcatttttccaattcaggttccacccttttagagagggctttcttgaccacccagtttcatgcagccacctaggcatgctctacactttacttaattttgagtagcaccctctttattttccaaaacgtttgtggtgttttcattttggctgatttcttaggagcttaaaacaacaaacattatttcatagattacatggttcagaatcccaggtacagcttaactggattttctgtggaaagtcccacaaaactgtgatcaaggcgtcagctggggctgggttctcatctgatgtttgaggccctcttccaagatcacaatgttggcagaattcatttccttgcagctgcagaactcagggaagtttgcttattcaaggccagcaagagagagaatctctgacttcttccatctctgacctctagaccctctgtttgtttgatttttaatagaccttatttttagaacagttttagatttacagaaaaattgagcagattgtagacttcccatagtatcctctgccactgtatccagttccctgtattattaacatgttacatgattatgatacatttgttattactaatgagtaaatatgtacattattattagccaacggccccagctgactccgattccctcagtttttacctgatgcccttttctgttctaggatcccgttcaggacaccacactgcacgtcattctcgagtctgcataggctcctcttagctgtagctgtttctcagactttccttgtttttgacgatcttggcagtttgaaagagtactagtcaggcatattgtagaatgctcttctattgaaacttgtctgatgtttttctcacgattagactgggttaggggttttggggagaaagaggtaaaatgccattttcatcacatcatttcaacatg

SEQ ID NO: 1321 - DNA, 6398 bp, Homo sapiens
aagtgccaccaaagtgggaacccaggcagaggaggcgccgaaagcaagcgagggctctgaggactgccagcatgctgtcacctgtcacttgggcacagctttttttcctggcaattcttttcaacatttctgttttaccagtatttttttcaattatgtaatgaatacctgcatatgttctctttgtacacattccagcattacatataaagcagaaatgcaccttgactaccattcctgattcagtcccctgggtatcagtttatttttaaactttcagactttcccccatgctttttctttctctctctctctctataattacacgtagcatgtttttatatgtatagatttttatatagttgatatcagctgtacacgctatatacatttttctgaaacaactttcttcactcagctgtcttggagctttctccatatctagatttagctaatccttgtaactgtggcggggtattccacagtataatatatcatattttatgtaattaaacataatgtgtctgggctgggtgtggtggctcacacctgtaatcctagcactttgggaggcggaggtgggtggatggtttgaggtcaggagttcgagaccagcctggccaacatggcgaaacccgatctctactaaaaatacaaaaaatagccgggcatggtggtgggcacctgtagtcccagctactcaggaggtggaggcttgagaattgcttgaacctgggaggcagaggttgcagtgagccgagacggtgccactgcactctagcctgggtgacaaagcaagactccatctcaaaaaaaaaaaaagatactgtgtctggaccaatgcctccttttacaaaaatattgggggaatgacccccataatatggtgaactgaaattcataaactatattaatttacctaaaatgattaaaaatcaatatgatgtcctaattgaatataagaatataaaggaaagcaatttataataaaaataatttgcattttgatatataaatcattcacatttgataggtatgtggtacactgtagtagataacataatgacatagacaggtgcttgcccctatatggagacacaagggaatgtgacagatccaaatccagacagatttaggtgtgttttgttactgatttaaataatgtgtgtgatgttgccatcaacttcatgatttttctgagatgataaataactcatggtaaagattcaaattaaacaaaattccagagtctttcaatttatttgatggtttcatttttagaaaagtcactgtatattaaaagtgtgcaaaaattactttatatatagtgtagttaaattcttggctcagatgtttttcgcccacatgaatgcctggcaggacacccaaagtccttgctggatgggggaaaattcttcattttttggggtccatcctggctgaaaccaataaatgtcaatagtaatcccgaagacggtgaccaccaaaaacactcacataaatttcctaagtaccttttagaggggggcactattcacattaagaaccaatgatttaatgataatgcttatgctttctcccccctctagatgttttcacaaggagcacttttctctaagcctttttgtgcgcatgttgcaacaattcctcagggaagaatattgtttcaacttaggtgctctcactaggtgggggcatgaagtgtgacttctccagaggatggctgtttcattttctgtttctcttctctatgtgacctccagacctgggttggagcaaattccagttcactcagaaaacccagagctatgacctttcttttatctatgggaatccagccttccttaggggaggtaacccttactgggccttctcagaacagtgtttcactcatgatttcaaagagctcaccctactcttccaagaaggccctcctcagctagtctgacttgtttgtaaactaaacacattgtgaggtttaatctctggtaagacagccctttggtggggatgccaccacttagacaaagatcagattcagaataagaacaaaataagcagaagctattattattagattcattgattagcaaggtatcttaatttaaaattgtcagtagcttgaaggcatttcttgaagagatggtaaagttggacttcgtcccagagagactgatgaaaaggaaagaggtaagtactgagaaagagagagaaagtcagaatcctggaatcttaggctggcaggaactttgaagatatctagtttaaggtctttgatgcccattgcaggattcaaaatattaagacgatgctgttatgagatttgagatatgtttgttagtaagaaataaaaatacctccttctttatttattatttttatttttatttgagatggaatcttgctctgtcacttaggctggagtgcagtggcgcgatctcagctcatgcaacctcttcttaaagggttcaagcgattcttctcagtctcccgagtagttgggactcgaggcatacaccgccatgcctggctaattttttatttttatttttttatttttagtaaggtcagcgttttgccacgttggccaggctggcctcgaactcctcctgacttcaagttatcccccagccttggcctcccaaagtgctgggattacaggcgtgagccaccgcgcccgggccctcttttttttttttattatttttattatttatttatttatttatttatttatttatttatttatttatttattttttgaggcggattctcactctgttatccaggctggagtgcagtggcgcaatctcggctcgctggaaccttcgcctcctgggttcaagtgattctccagcctcagcctcccgagtagctgggattacaagcacatgccaccacgcctggctacctttttcttttttttttgagacgaagtctcgctctctcgcccaggctggagtgcagtggcgcgaccttggctcactgcaagctccgcctgccgggttcacgccattctcctacctcagcctcccgagtagctgggactacaagcgcccgccaccgcgcccggctaattttttgtatttttattagagacggggtttcaccgtggtctcgatctcctgacctcgtgatccgcccgcctcagcctcccaaagtgctgggattacaggcatgagccaccgcgcccggttcctggctactttttgtatttttagtagagatagggtttcaccacgttggccaggtcttgaactcctgacctcaggtgatccacccgcctcggcctcccaaagggctgggattgcagacatgagccaccgtgcctggctacacacatatctttatataccttgccttatcaaatgttcctgacgttgccaagtacttcatattacatttgtacacatcaaatttgaaaaagagggagcgatttatcctaggttacatattgagaaagtgacaaaagtataactgaagcccaattcttctgaatctaaattatatgcactttgtaacagaccaatgctaaattaatttaaaatggtagaatgtcatgataaatattttatttttataactttccttggaatgtcaccctattttctgattctttttacttatttattttattttattttttatttttattttttttgagacggaatctcactctgtcgcccagggtggagtgcagtggcgccatctcagctcactgcaaactctgcctcctgggtttgcgccattctcctgcctcagcctcccaagtagctgggactacaggcgcccgccaccgcacccggctaattttttgtattttcagtagagacaaggtttcaccgtggtagccaggatggtttcaatctcctgacatcgtgatccgcccgcctcggcctcccaaagtgctgggattacaggcgtgagccaccgcgcccggcctctgattctttttaatatttgcctgcatgggcgtatttactcattgtcacctggtgatataaatatgaaatattatgggaaaaaggagaaacagggaaggtgagaaaacacttgttagttattcaaaacagcaatcttggttttgaagtttgaagtttaatcactgagaaatggcacagaaataaagctggtttctttgggttccatcaggcaatgtgaaatatcgtgaagcgaggtggtatcacggagttccatccggggcaaatgtagaatggcagcagcttcactacatttttctgagaaaaacagaggcatagacagtgcatctcataaaaaagagcaaaacctggagtgcttacgacatccttaaacaggattacaggaaaaaatgatggatgtgaatgtgtttagcacaatgtcagcttcatattagatttttaattaatgttggtttaatttgaggttgtatctctcttctggaactacttaatatcttgtggttttttttttttttttttttttccttccttccttccttccttccttccttccttccttccttccttccttccttccttccctccctccctccctccctccctccctctttcttttcttttcttttccttttttttggagacagagccttgctctgttgttcaggctggagtgcaatggtgcaatctctgctcactgcaacctccacctcctgagttccagcaattctcctgccttagcctcccaagtagctgggattacaggcgcctgccaccacacccggctaattttttttgtatttttagtagagacggggtttcaccatgttggccagggtggtctcgaactcctgacctcaggtgatccacccgcctcacctcccaaacttctgggattacaggcttgagtcaccgtgcttggccttgtgattttttaaaatacatttttttcttacttttgttcccattatctgatggaggaaaaaaatgaacaaatctatcaaccaacttacctgggagcctggtgctcatttcctattggttccacattcactccctagtcctcctgcaaccactctgaaatcccttcctagttttacccagctggaaatgccaccactttagccatactgaagttcttctacattcttcatttctgcatgtgcaggcaagtaaaatgatagggatttctgtgggcgttgtcaggagctgaaagattgggaatgcttttgaaaactccttctccattgagtttaagaggaaacgggtgagttttcccattatttcggtaggatagcagatgcctcttcatttacccctttattttaccctcccatgcccagttctgtcctaccactaagagtgagtacgtcggttgccgcattctggccttgtcctaagaagtgtttcacaatctaacaccaccaatactcccctcacccccggtgccttaagtaaggaaggactgggctgctgagtggcaggtgggggctgtctgaggatgggagggggaaataagatggaacggggtggacagaaaaaaaatcaggagaaaaattattatttgagaaatggaaatcttggattaggattttttttgcaagatgattaagccattttagaaacatgactcatattgtcttctgccctttcttcctctaagtaattatgaagaacacatacttggaagattttaataaaattatgagtaatattagatcactttaattcctgtttacggaggacagcagtcaagtacctaactgtgagaggaaaatgaatctttgcttctaggaggcaccatgatttacgaaaaccaaagagggccaatttgactgtttttacttgtacccctctccttcttgacttttctcattttttcttaagattttgtcaaagtgatatatgcatctagaccaaagagccaggtatttctgcttaaagggacatttctttgtttgtttttttaaaaatagaggctttcgtttccatcctcttccaattcctgtttcccaaggcaactactttcaactcttttacctggtgtgtgtgtgtgtgtgtgtgtgtgtgtgtgtatgtgtgtgtgcatgtgcacgtgtatgtgcatgtgtgtgtgtgtgtgtgtgctttccgctatggaatatgaacctttagttcttcctcaccctcattcccctggcaaacaccttctgtctcccacttttcaatatagttttattgtaatggtaaaatcaatatttagtgtttaaaatattatgccaatgcaaatgctattcatggtgaaaccatgtattaaactgcaattaatttttctttcctgtacacatttttgtttccattgatttaacaattaccttgttttgtttgctttttgttctcaattccatcatcaagtatcctcaaattttatttgcctgagaaaatttctcctggggcttcatatcctgctccagtctggac

SEQ ID NO: 1322 - DNA, 2079 bp, Homo sapiens
gctgagattgtgccaccgcactccagcctgggcgacacagtgagaccctgtctcaaagaagaagaaagaaaatcagttaaaaatgagtgggttacttctaaatggcccttcaacaactggttatccaatggaagaaagcgaaattgtattttaaaaatgttatgcaagaaaacctctagaatccgtatataatctagggtcttgaccaagactagatgcaacagaaaattatgtatgtttgtttatataaacagtaacttttacaagaaaaaagatgtcacacttgctggtaggcaaaggatattttgtaggggaaaattctgaatagtgtaaactgctaaaaattgaaaaatggacaaaggatatgaatacgcaattcctatgaaagcaaatccaaatggcggacatgaaaagctgcctattcaattaaggtaacatcagtctatatttatcagaccaactaaacaaaaaaatagtaacaccagctacaaatgggaaacaagaaaacagtctcacatgctgcaggaagaagtgtgcagtaagagactttttagaaaactggcaatatctatttaaatgaaaagtacacacgcttttacacagaaacctcacgtttgggaatataccccataggagtgaaactattaattcattgtgatatttgtacaagatatagcaacactgtttgttatgagaaaaattataaatcaaatacacactcatcagtaatgcaatggtttaactgcagttcatcaacactatggaacatcaggtaaccattcaaaagaatgaaatgaagctacgtcagttgatcgagagggacctctgattattacagagaaaaggaagacggagaaaaataaatataacatgattccatttttatatatgtacataaaagtgtatatagttctaagatattagcacagaaaaacaggatacatattagatcatccacgggatccccagggaggtggacagatgggagggtggcaggatgaaataagtaaagagacagaaaccagagctctcaaaaatgcttcaggttaaaggtgacaggttgaacacagttaagatacccactaaaatcacagtaaaagcacactcctcgagaacacgaatgggtataagagtgaatggactatttaaaatgaaaagtaattgacttagcaggggaaagctagaactggaaggagtagaggcaaagcactaattcacccacagaatccgagagaggctcaacagagaggggcaacagcagagaaaacacagatactccactcataatgtaaaaacaaaatatcaaacaagatcaagagcagaaagggctcgtagctaatctctaaaaatagacaagaaagattagcagataaagtagaggaagtctcagaaagaacagagagacaaggaaacaaagaacagaaggggagaaaggatataagacagaaattactctctgacatgcatgagaatcatccaggaggccccacctccagagctggattcagtgaggctgggctggggcccccgaacctgcacatcctaacaagctcccaggtgacactgctgcttctagtctcaggtccacactgtgagatcctgaatctcaggggttttagtgcaaacacagaggaaacagaggggcagaacttgcaaaagaatgaatacaaaacacatttctcagacggaaggtcacgatgctccaggttgaaagggctcatcaagggaggaaagcaatcaacaaaaagacctccactgaggtgtagttctgtgaaatgtccaaatatcaataaagagaagatcctacaaacttctagtgaggagtaaaagggttccaacaaaggaacaagaatctgaatgagtatagacaaaggaacgctgatccagtttatagggtaaagatactttgctggctgctgagagggaactggatgggaggagacagccaggcctgcagtggtacaggcaagtgatatgtggctcaagatagggctggtaaacctaagagtggatctgagagaatttttaggagaaaacagaactcgatgatgctttaggtttaatctggcagtactgagg

SEQ ID NO: 1323 - DNA, 2228 bp, Homo sapiens
caatttggaaacatctggctgagtcattttggcccacattttctttctgctgaattcatttgcattctcccagggcgacatacataaatgttttctagttcatgttgacatctttcagttattcatgaactgtgaccctactaccctgtgaggttctatgagaagctctgtgtgttgcaattctgtctgcattgctttgcagatgatgagttgcctaaaatgaatgaactggttctgacctatctaagtgtatcacatggagatgctcttgtctcttgatttcagtctaggtgacactcaggttttccaaaagttctctccctgatacacacattatttcattgtttcctgtgtgctaagcgcacacaggatgcaaagatgaataagaccttcccttacggagccctcagcctagccatgacgagagccagttatggagtccctactagatgtccattgctttacatagtttctatctcattaactttggtgcacatagccagtaagcgaaaggacccgggatttgcaaacaagaaattattctgacttcaacgctcattcctttcactgatgggcaaccctttatcttacctggtccctgccacggagaaactcacaggcagggccgggcagagaagtggtcagtgatgctctaaggtaacaagcacttcccataagcctggggtaggaggtgacatttgcacggggcactaaaggatgattaggagctcatcaggtggaaggagttgggagtggggctggagctggtgtctttgctaatgccttctaggggaagatgccaagtgttttagatttccattgcttatacttatctccagtttttagtggcctacttgaatgtcatttatattgtcatttacaccactccccaaggccaaatcatatctgtgttgcaaagttggccaacagggattgtatgaactgagccttctctggagattttctgcatgggtctgttagttcatgtatttcatgttgagaataaagtatgggcacgtgaaggtttgggggatattttacataagacattctcctatgtaggcatgaaaatctttcctgactccaatcctgttgctaaacagcgaggtctagcccagaaggcatggaggggagcagagtttctgggaaacaagaagaggacttggagccccagacaggggacaactccagagggtttcttggggatacctttccctacaggccactgaagacagcacggcagtggaaacatctgcatcacccaccctggtgtgtgttcccccgacaatctgtgggcttgttccacagctggcaccaaattctggctgagcagacagccccagaaatgtcacctggagccgttaaaaaaacataaacaaggcatctgtcacgctgccgtcgccaaggtcatctggtggcaggaggtgaccgaggaggagcatggtggtgccgtgccatcgagggccaacctgtgggcagacctgcctgtgccggcgctcccttgctctgcagatgcattcaaggatgtgaagttgtgcaggggccagacgtgagaagcaaaacaacctgaatgaaatccagccactttggagtgaaacatgagcattttaaaacatgattttcaaactgtcgcagggttagtattgcatctggtctcctctcatgattgcctggaggccaccagcccaaagctggagtgagacatgagctggagggtaacctgaacaccgaatttagggagtgtgttgttcatacaaatcactcagactgagagttagagatgggatttacacccaagctatccatcaaaccactatctgtgtgaccttcgacaacttatccatttcctctaagccccaattttcatatctgtaaattccctcctaggatccttgtgaaggttagataagatagtatgtgtaataatgcagggctgcagagggccctcagtacattttattttggctttctctgccctcacttacaggtgagggaacagatttagagacggggagttcatagcataccagcatcaatgatcctagcaagaactgtcgtactttcttcctccttccttcacttcctttttccttatttccctcataatccactccccttcccctccctaccctcagtgcacatgatattatgtttgatgggtagcttttggtttgtatataattttggcaaaacacattctttgtagaaatgtattctttaatttgtta

SEQ ID NO: 1324 - DNA, 2802 bp, Homo sapiens
atacccgtgtaataaacctgaggtcaggagttcgagaccagcctgaccaacacggtgaaacctcgtctctattaaaaatacaaaaattagctgggcgctaaggtggtggacccctgtaatcccaggtactcaggaggctgaggcaggagaatcacttgaaccctagaggcggaggttgcagtgagctgagatcatgccattgcactacagtctgggcaacagagtgagactctgtctcaaataaataaataaataaatagttgaaaagaatgttaacatgtgattgtctcatccatgatgaggaagtcatgacgggctggacagcaggcaattcatatctcagtgctccatgttttgtggcaatctgttcttaccttttctaaattttgaaataagaaattttaaatgacctgaaacacaatttttgaagtcaagccagtctacagaaaatgcatattttgcatcctcttttcaagtcagacaaggcaatcttgcatctcagcatcagcctcttgccttcatacatcttacctcagttcaaggggatatttatctaaaaataacaaatctaaaccacaggaaaattcatgtgcccaaagtatgcaaatccctgctgactaataaatcaacaacttatgtcacaaagtccaatagttacaatgaccagaagtgttatacttatggcatcttggataagggaggcactggaggacagaaggtcattcctgcagacagagagccagctactttacaaggagcttcagattctttaagatcagaatgacactgtccaaatccagattcaatcactgtttcatatattagtcttagtgtagaagggacttgaaagcttcttggaaaatgaagatgatcatgcaataacaataacagactttgtggattatcatccaattgccttttggaagctggtgtggtgctttagacattttaacttgtgcagtcgcttagcaggattgttttttttttttctgagcattgtaccaggtattcaaagattctccatcattatatgtctgaaggtgataaatacattttagtatgcatgttttagggaatataaaactacatctggatctgggacacccttgaacatcctctggaatgtccacacacaaaatgacccaatggtctctttattgcaaaaaagtgataatttacttaaccaggaactactgaaaagtttgtttgggccgggcacagtagttcacgcctgtaatcccaacactttgggaggccgaggagggcaaatcacgaggtcaggcgatcgagaccatcctggctaacacagtgaaaccccatctctactaaaaatacaaaaaaatttagctgagcgtggtgatgggcgcctgtagtcccagctactcaggaggctgaggcaggttaatagcgtgaactcaggaggcggagcttgcagtgagccaagatcgtgccactgcattccagcttgggtgacagagcgagactctgtctcaaaaaaaaaaaaaaaagagtatgtttaaatcattaaaaattaatctgtggaccaatgaggcatttagagacattgaataagtatctgcattttaagacatagcagaggtagtgtagagaaatatgaatcctttcacttttggatctgggaagagaaaatatcgacataagatgcttttgatatagattataagatggcttaggatcaccgtaccatgatcatatcacagttaagcaagaatctatgcaactgtgatggatcgcccaggaactacaggggtggtagagtgctgaaaaacctttggaagtgtatgtgaatgcatgtgtactttcaatatgagttgtataatcagcatgtaaagcagtacttctataaacatgcaagaaaaaaatggaagtcgtaacaatggcaaactgccacatatcaacgacagcagcaacaaaagatctagagctaaaaccattagaatgaaaaagatactgcagaaatacagttttcatgagccatttcagtctctgacagatcaaacagatgcccctcaagcttgataatatatttgagcaatataattttaaaaagtaatctgtatttatatgtatctattataaccttgccaaggctaggatcttggatgtggtcctttaatagctggtcactggatctttggggaaaaaagccatctagcataaagggtaaagcactggaatcacacaaacaggttcacttcttgactcttctgttcacttaataaaaggaaatattttgtttctctgaacctcactttcctcatgagtaaaatggggtaatggaacagctgtctgtgataatgcatagaaagccctgtaacagtgtctgctccagtgtggatgcccaatgtacatcagctctgattgccgcagcagcagactcccgtcatctgcccttgccttcctctgccaagggccattactcaggcctctccactgacagcagagaggacttgcctggcatacaattcatgccagtgttctcctataacgtcactgatttctgtaactaccgtatccacctgttgtagtagggggccacccctgagcttctcttcctggtggggagagacgaggaaagaaagcagcagcatctcctaggcaatggggacaattttatcacttctgctacctagatcccggagctaaggaggaagctcccagggcacatcagccttgctctaaagaccagttccccagccaatttattgcttaactgtctaattccacccaggaatccgaatggactccccagcatcctagttcactaactgtgcctgtatc

SEQ ID NO: 1325 - DNA, 6473 bp, Homo sapiens
tggtcatgttgcttgctgtcctacttaggttggggggtcaggccggcgggaagctcgggcatggcgggctgcaggtcccgagccctgccccgcagggaggcggctgaggccgggcgagaactcgagagcggcgcgggcgggccggcagtgctgggggacccggcgcaccctccgcagctgctggcccgggtgctaagcccctcactgcccggggccggcagtgccggccggccgctccgagtgcgggacctgccgagcccgcgcctacccggaactcgcgctggccctcgagcgccgcgcgcagccccagttccctcccgcgcctctccctccacacctccccgcaagcaggagccggctccggcctgggccagcccaaagtggggcccacacagcgcagtggcgggctgaagggctcctcaagcgcggccagagtggacaccgaggccgaggaggcgccgagagcgagtgagggctgctagcacgttgtcacctctcaacctcatcaaaatgtaagggttgcaacttcgtgtagtcatacccaggactaagaacagggttcagtccatgggaggggctcgatatgtatttttcaggaaaaaacatcaaataaagtaaaatagtcaaatcaaaattcaagcttttcagcgaaacttaacattttagataacttgaatttaccttagcgagcttgtccgctttccactgcttgaagaccttttctgaataaatggattattcagtccatcatgataagcccccgggtgtgaactatgaaatggagaaatcagtaatgaagtaaatgtaattcaggtccacccttccttattctcaattctgaccttcaaaaagctctatcaacttaaagtttaaacaaaattttttttttcgggtaatgtattctcttttttttcatggaatactgtttttacttgaaagaacaaataacagaaaactcttcgctattgggcagacattttctttaaaaaaaagggaaagaagtggtcgggcgcggtggctcacacctgtaatcccagtcctttgggagaccgaggcgggtggatcacgaggttaggagatggagatcatcgtggctaacacggtgaaaccccgtctctactaaaaataccaaaaaaaaatagccgcgcgtgatggcgggcgccttgtagtcccagctactcgggaggctgaggcaggagaatgccgcgaacccgggaggcggagcttgcgctgagccaagatcgctccactgcactccagcctgggcgacagagcgagagtacgtctcaataaacaaacaaaaaaaaaagggaatgaagcgggcctgttgcttcaaagaaaacaactgaccgtgtttattgctaatgagaagatttaaacttttgtcaggtggggggggtcacatctgtaatcccagctactccggaagctgaggcaggagcatcacttgaggccaggagttcaagaccaccctgagtaaagtagtgagatcccatctctaataataaaataataataataataataataatttaagcttttaaatgaaacttaaaattttgggtaacttggatttatcataatgagcttgtcagcttttcaatgattgaagacttttctaatcagatcagtggtaatattaatgaatgtgctatcttgatttcgtataataagatgtgttaatatctggaagatcaccataactcagtgaaccaatgtttgccagatgatcagtgaatcatgttacaaaatgcatgaataaaagatctaattaaaagaacaagacagatcaatggcttttaaagtatccaagtaaaaaaatttcattgacaaattttcagattcaacattttagctaacctctatgaaaatactacttatcaagttgtggtgcagtagcaaagaaaaatatccacacttatctgaaatggctattaaaacactctttccttttccaattccatacctgtgtaaggctgattttttcatatacttcaatcaaaacaacatatcacagcagattgattgctgaaccaatatgggaatccgggtctcttctaccaagctaaacattgaagagatttgcaaaaatgtaaaataatcttctcactaatacttttgttttgggaaatatagttattttcctaataaacatacaatacattttatcgttatatttaggagttaataaatatttctaaattttatcagttttaatttctgacatgataaatattaactgatatatcccacataagcaagagctctctaacgtctttattaattttcaagaatataaaggggtcttgacaccaaaaggtttgaaaaccacagttttaaagcatcttaccaaattaaactctacatttaatgtaaaggaaatcataatgttgatggtacattttatgcaactcagccaaataattctgaagtttatttgggaaggaaaatgttcatgactagctgaagaaattctgaacaagcaaatcaatggaaagaaacatccctactcatagtaagccatcatataaaacacaaaaaaatagcagttaaaactgtgtggaatcggccgggcgcagtggctcactcctgtaatcccagcactttgggaggccgaggcaggcagatcacctgaggttgggagttcgagaccagcctgagcaacatggagaaaccccatctgtactaaaaatacaaaaaaaaaaaaaaaaaaaaattatccgagcatggtggcacgcgcctgtaatcccagctactcaggaggctgaggcaggagaatcgcttgaacctgagaggcggaggttgcagtgagccaagatggggccattacacttcagccttggcaacaagagcgaaactctgtctcaaaacaaaacaaaacaaaacaaacctgtgtggaatcagtacaaaagtagataaacacatcaataaaatacattaaaatacagaaattgatccttcaaatataattatgaagacttatgaaaagaggcctttaagtagggaaaaggttgtacaataaatgatgttgaaatagattcggggcaaaaacggaatgtcatatgttgttttggtcaaggttcatagtttcaaaaaataaaattccttcaaactagtttaaggtaaatggaacatattagagggtacgtggagtacacaatccttgcagggaattcgtgaagaaaaagattccagtgtttattttaaggaatgaccagcaaaaccaaaccacagaactaaacagcccgaggaactggtgcatatactacaaaaggggaagctgcaaaaatcagacgtttctaccacagcagtgaccagaaccacaccacttctcaggaagatgccaaaacaggaatccatctgcctgatgagaagcggccaccatagttgttgatttcagaccttgctacttccaccatgacccaaacctgcaaagtgaatgccccatgccctttctttctctcaaaataactcagttcaaatcacagtctcttgtgagaacctctgattggtagaatgagactcgcatccctaaaccctggttctatggaagtctggaaggtcagaatggtcattgagacatactgcatttatgacatgatccttatctctcaccacagcaaaaataaataaagaacaaagccattacacaaaaatataggcaagcgtttttataatcatacgaaggagaaagatttcaaaaacaaaatatgaaccccagaagtcattgtataaaaaagattaatagccttgactccctaaaaagtgaaaacttttagatgacaaaagagaaacaaaatttagaagtctcatagctgggagaaaatttagcaacatttatagcaaaaaaaggagggtttagaattaataaaaagaccttacaaatcagtaagaaaaagatatccagctctatgaaattggggaagtgaaatgagcaagcaacgatattcgactgttcttgcattgctagaaatacctgagactggataattaacaaagaaaagcctttaattggctcacagttctgcaggctttacagaaagcatggtgctgacatctgcttggcttctggggagccctcaggaagcttttactagtggcggaaggtgaagcaggagcaggcatgtcacatggccagagcaggagtaagagagagagagtgggagatgccagatactttaaaccagatcttgcgtgaactcactcatcactaaggtgataagccattcatgagggacccacccccatgatccagacatctcccactagtccccacctccaacactggggattacatgtcaacatgagatttggaggggaacaaatatccaaagtatttcagtgatatttaaataaaagctactttttatcctatttgtataaggatatagttgttttgcaattgcacagaaatctagaggaataaaacacccttaaaagaggctaattctgggaaggaaagtgcaagtgaggggagaaggaggttgtcaaaagggccctttcttttgtacatcttccctgttgtttgaatttttacaaaaatatatttgggtattagctgtacagttaaactataaaatcttattttgctggctttataatagttagcaataaacatatatttttgcatttcagggtatggctggaggccatttcagtgcaataacaaccatggtgggctttttcaatgcttagatgtattttctgaaatcagaagcttgtgtttatactttggataattacaaatccttgataattaattccatgcaatttttaccattttgctcatatgatatacatttcttgattttataattgggaaataaatattttatttatttcatttttgagaccaggttttactctgtcactaggctggaatgcagtggtgctgtcatacctcacagcaacctcgaactcctgggctaaagtgatcctcccacctcagcctcctgagtagctggggctacaagcacaggccaccaccccagctaatttttaaattttttggtagaagcagggtttcactatgttgcccaggctggattgaaactcttggctcaagtgatcctctttctttggctcccaaagtgctgggattacaagcatgagccactgtgcctggcctagtttgttttctatttatagtactacttactgagccttcagcaatagagtaggcgtcaccaattgccatctccctcacttctccctaaataatgatattcaatttttcaccttcatacaagcatagatttgtgactaattatagaaaccataagggaaaaagaatatacggagggataagtgtccaaaaaccctgtctttcctgaaataattcagcagtattgatttagagcagttgaatcattaccaccccttctgtaaatatatcagtcaagacagaaataacttctgagaactgagcctcttcctactcagaagtgctgtgactgaaggtaacaaaaatcattaaaaacttgaaattgcaacaaaaggaatttagattaaatttaatgacaaattttcccgctgtgaaagttattaaatacttgaagaattataaaactgtgaacatttatatttaaaaaatgcacctctctcaatcatcattaataatactttagcaattccacaaacattttttgagtatctactatgttccaagttctgtgcttgtcactgggaagtataaagatgaatgagacatgatcctacacacagggaatgtatcaaacctgtgagagaaatgaaatgcaccaattcattcatttgttggataaatattgtaaatgccaaccattgggcattagggatatgatggtgaccagcactcgactatggatgtggaataagggaagaaaattctgtgatgggttacagtggagcaagattattttgcctgtgatatgaaacaaagctttatgtaaggggcatttgaactctgtcataagtacagttttaatagataaaaatatggaaagaggaaatgtcaggttgagagaacagtatgagggaaaggaagagaatgtgatagtagagggtgtgttggtatgtacctgaggcagaactgaaactcaatacatgataaacacaataggatgctagaggctatcactaacaacccctaaatctcaatagctcacatcacagtcacatttagaattcagactgtgatcttctacatggagattcatgaatctcttgggtctctcttccttactaattctacctgtattcagcagacaaagagagacagagaatgaaagagcaagaaagagagatcatgacatagaggaggctgtacagagtgagcactagaacttgccatgcatcatttctgtccacattctattggccagaactaagtcacatggatgtggtcccacttaaacacaaaggagactgggctatgtagtctcctgcgtgcccaagaggtaactgagcctagtttgttgatcacttaacgttat

SEQ ID NO: 1326 - DNA, 2843 bp, Homo sapiens
cttagggacaacaactaacaaaacagcaaacgggtcctttctctattcacttctaggttgctttcttttgggttcaactctaggcctatttattctacaccttcatggaagaggaattgtgcaatgaggcctccaggtaatcagaggatcagggaggccctctgcatgtgcaaatgccacctggtgcagataaatccaggctgatgccaagaggctatgtgagaacagagaaagttggcagccctgtgctagaatgaaccctgcatgtagttctgggaggacagcttggaaaaggataagaatggctacagactgttccctaaagacaccagcccaaagggccgctgagacctgaaaagacaatgaaaggtcaagcttcactgggaaggaaacacacatatattggtgcactgccttcgcagagaaccatcgtaggcctgcctaggagtgctgtctttggtttccagtgctgctgcagaaagggccactcaaatggccaaatataagaaacgggcaagagagagggagaggccatgtaaggacagaagaaggagacgaggtatgttcaaagtatttcaagttactaggagtacaaatgttcaaacacagtcttggttatcaaaccctggaaggcagaactagagcaaactcttgacacttgaaaaggaagcagttagtacagataaaaggaactgctaacttacacagtgggtagtcaactcgtctaattcattatccccaagaggtgagacaggttgaaaatacaaattgctctttaaaacgtttggagaaactggcggatggtcgattcacagtggattcttgggtagatcgtgacttttaggaggggatccctaaggactgagagcagagaggagaactgtggttattaaaagtctgggtatggtggccagaggcagcatttccagccacatggaaaacggttcatttggacccagggtgccaattctgatgctcttgtggggctgaaggaggtaggaaatattaagtgcatattctgagtagagtgaatatggcttacaaaaagtaattgctgctccctacaaatatatgagccatgtcatcagggagaaccttaaaaacctgagtttaaaatccatggggctttggaacactcttgcgatgaaatggaaggagcatgactctgtcaacagaccaggatcccaacaggcctgcacagccataggaagggtgtgcagggccgttcctactgccataagacgcagggctggcttcacctgcgtgcagcctctgaagctgcacaggccctgcacttagaagggcagctgcttggtttaatgctctgctgttgccatctggaaattctcgatactttttgaactacaggccctgaatttttatttttattttttgagatagagtctagctctgttgcccaggctggagtgcagtggcgctaactctgctcactgcaacctctgcctcccaggttcaagtgattctcatgcctcagcctcctgagtagctgtgattacaggcgcccgccaacacatctggctaatttttgtatttctaatagagacggggtttcaccatgttggccaggctggtctcgaactcctgaccttaggttatccttctgccttggcctcccaaagtgctgggattacaggtgcgtgccaccatgcccagctaattttttgtatttttagtagagacagggtttctatgttttggccaggctggtcttgaactccgacttcaggtgatgcacctgcctcggcctcccaaagtgctgggattacaggtgtaagccactgcgcctggccaggccctgcaattctattttgtgcaggcccccacaaattatgttgctggtctggttagcaactactcagttgatctaatagtggaggggccagagaagggccaaggaagaaaggccaatcgaggcagctggatccaaatgataccaggaagtgggacatgtatagaatgaacagtttcctaggaaatgggttgctccatctaagtgtcatacacaggctttgctgaaaacatttcctaatgtcagggaatcagccaagagaaaccaggcctgggagaacctggggtgtacttgacggtgctcaaccacctgctgcatggccaatccatgaatggaatcatctaggaaattccaacatcatctagaaaagagaaaataaaattagccttattgggcctggtcctgagtggatgtttggaagttgaatgtcagccttgccccagacacgtgtgtttttcagaaatattcttaagtaatgacttaagcttatgacaagggccactcctgagttatctgggaagctcgaagagcctggattctggatcaagggtgaagacgatgaaagagggaaaacaaagaccctcacaggagtgaggcgatgcccctccgctcctctcatctctcctctgacggctctgaagcaacatttctaacaagcacttcgctcttggggccttggcttttccattgccagagcaagtcaactcaaatcctccttagaaagcacaaaagcgctgattcagttggaaaagtggggaaaaaaataccactactgaaataataactggagtgctcatattgtcacagaagtaattacagaagaaacaccaagattcggccccggaaattttctaaagatgcttctgcctctataaaccggcattttccagctgacagagaaagaagttgctataaattaggacgagactgtactaaaggaaatcctggattgcaaggctgtacccggttagaaaatttatttatttatttattttgagacagagtttcacttttgttgcccaggctggagtgc

SEQ ID NO: 1327 - DNA, 1832 bp, Homo sapiens
attggacctttttaaattttttttgagatggagtctagctctgttgcccaggctggagtacagttgcacaatctcgcctcactgcaacctccgcctcctgggttcaagcgattttcctgcctcagcctcccgagtaactagaactacaggcatgtgccaccacgtctggctaattttttgtatttttagtagagacggggtttcaccttgtcagccagggtggtctccatctcctgacctcatgatccacccatctcagcctcccaaagtgctgggattgcaggcatgagccactgcgcccagccaaaatttgaccattttacaggtgactcagacagatgaagcaacttttccaagataactcagctattatgtggcagagcttggattttagacatcaagcttgtgttttcagagagacttggaagcacctcatatcataacagcagggcagctgtccatgtactcaggctggcaccagaggccccaggaagacttgatctatggccacttccataaggtgaagtcctattttctgatggcggttatgggaggtaagattggaaagggttaacagatggtttgcagttccttcaagaaccctgctgacttttgtacagtaaaataataatgttccaatttggaagcgaattttctactgtgacactaatacagccccaggctatcagaggattagatgagtacaaagctgtatgagccatcagctgtggcactggagggtgactcagcacgctgggcgctgggaggatggctgttaattggaactggaaagaaggagccctggtttggcagatcgggtttaaatgggtggattgtctgatggagactttttctgttcttttttggctttggttcaatgcatatagccagactgtcctgctgccagctggactttgcttgaaatgtgtttcttttctttctttccttgctttttcttttttgtcagtttgtagctccagattcataagagcttgggttaagtgagaagcagtggcaatacagccaacttgcatcctttgactctgaattctctgagaccccattttactttcaagttcatttccttctgcagtcagtactgtcctgggctccttccctcctaatcatagagccactgttgactgcaagtttctcctcagtgcagcccaatttagtaaatgtttattagggagttagggagatacaaggaacagaggatgtgctggataaagaccagagttctagtactgctcttactacttggacaaataacttgactgcccaaagcctgagcttcttcctttgtaaaatgcagattataaaaatgatattcacctggcaggttggtctttaacctatgcatttgagaggctaccgtattagtctaatttcacactgctgataatgacatatcccaaactgggtaacttatacagaaaaagtggtttaatggattcacagttccacgtggcttgggagatctcacaatcatggtagaatgcggaagatgaaaggcacatcttacatagtggcagacaaaagagaatgacagccaagtcaaaggggtttctccttataaaaccatcagatcttgggagacttattcattaccacgagaacagtatgagggaaactgcccccatgattcaattatctcccactgggtccctcctacaacacgtgggaattatgggagctacaattcaagatgagatttgggtggggacacagccaaaccatatcagctcctatgaaaccaagtagtaaaaactcagagaaactaatgtcttcttactgtttatgaaactcaagagccacactctcatgaagtt

SEQ ID NO: 1328 - DNA, 7482 bp, Homo sapiens
gcagagaaggggctgtctgcaaagatggaggggccagagggaagctgtacaaggtcatgctagaaggggttatgtgcaagtaagatttggctatatacacttagaatatgttggggtgaattataactgccaggcctttccaggtccctgagggaaacactttgctgatcttagcctccttgcaactcacataccttcatttctggagttgcaagatagtggctgtggtttttcacacaaaggggttgcaaacagggttagctccctggattaggtccctgttctgctagcctggctccttcctagttcctattaacttattgatttgttagggccccacagcagtctctgtcacaatcccttatctctgctgttgtagcacaaaagtagtcatggataatacagaaacaaatgagtaaggctaaggctatgcgccaataaaactttatttacaaaaataggctgtgggccagattgggtccaagggctgtggtttgctgacccctgatccaaaccaacagatgataaaactgaggccccgttagcttgaaggaaaaccaggactagaaatccacttcctgtgagtctcagagaagagctccttctattagaacagagattctcaaattttactttgcatcaacatcacctggaggccagagaggtgagggacaattatgagaaaacagattcctaagggatttttgactcagtaggtctgcggtacgatccaggaatctgaattttaaaagcacacatgattctgccctctatggcccagggatcatgctttaaaaaacatttccccacatcacagattcttttttttttgagacagggtttcgctctgtcgcccaggctgggttgcagtggtgcaatcatagctcactgcagctttgacctccctggcttcagtgatcctcccatctcagcctaccaagtagctgggaccacaggtgcacgccaccatacccggctgtttttgttattgttttttgttttgtgttttagatacgaggtctcgccatgttgtccaagctgatctcaaattcctgggctcaagtgatcctcccacttcagcctcccaaaatgcttggattacagtcatgagcccctgtgtccagtccccccacatcatggatttttgagttgcctgggcaacaagcaaaccctctgtatcccagacagacaagtaagcaggtgatgacgagatgtctttaaagtgcctcttgatttgttcccccttcccctttgccccagcagccctttctctttagcagctggcctcagccacggggagcaggtggggagtgtgcagacacacctgccggcaagcccaggagggcgtctctctagggagctttcctaatgagcactgcctgttgactgactggaggggaggagctcattattcgcttttggcccagagccttgtcttgtaggattgcaaatgaaggaatgcctgtggctcccacgttcacctcagtggaaagatctcaaagcaacagtgtagttcacacatctcactgaaaagggtcagatcagctggaaggaagcttgtggaagttgtttggcaccgaattttcacacttgatctattcctttcttcctccatccattactcccaccttgatcccttgaatgggaacattgtttgccccaagtcatctaaaacaaagtctctgttcttctgaacaatacctgccccccagcccccagatgcttaggaaacataacccataagaaaataacaggaggttaagaagattatgtcagcaatccttattcctgtaaaggggcgggcctaatccagccactttattccttacattagccctgcttcaaatccccgacgggactttttcttgtagctcttcttctcttggcaagaactctagaatgaaagctctagagccaagcctagatatttagtgttaaaagttaagttggaatttatagatgtcagttccaaaatgcccttctgggccatcccccagctgacacccaaggaaagggaagaggccgagggcagagatcagatttagacacaaggttgatggcctcgctgcagtaaccaccttctttaatcacaagaccacactaagcaaactgggtgcagtagctcacgccggtaatcccagcactttaggaggccgaggcgggcagatcacctgaggtctccatctaaaaaaaaaaacaaagcaccacactatgcagaaatgcaaaaagggaggtccctccctccgccaaaagagggaggttcccttcattctgcccccctgctcctgtcacccacaggtcttagaagagagggagccttagctggtcttcctggcagcttttgcacctgctgtctgtccatgacaccctgactcccactgccccctgtgcttctgagctgacatcgtattcattcaaaaatgtccattatcctctacagatgtccccgacttaggatggttcaccttaaaaattttttgacttaacgatggtggtaacaacaacatgcattcagtagaaaccatacttccagcacccatccatacaacttttctgattttcactaaatacatgaggtattgaacactctatgtaaaataggcttgtgttagattattttgcccaactatcaactaacataagtgttccgagaacatttaaggcaggcgtggctaggctgtgatgttctataggtgtattcaacgcttttttttttttttgagacagagtttcgctcttgtttcccaggctggagtgcaatggcatgatctcagctcactgcaacttttgcctcctgggttcaagcgattctcctgcctcagcctcctgagtagctgggattacaggtgcccgccaccacactcagctaatttttgcattgtttgtagagacggggtttcatcgtgttggccaggctggtggaactcgacctcaaacccctgacctcaagtgatctgcccgcctcagcctcccaaagtgctgggtttacaggagtaagctacggcacccagcctcctcaatgcattttcgacttatgatattttgaatttacaatgagttaatggggatgtaaccctgtcctcattgaggagcatctgtatgtgaatcctccattgtacaaatgagaaacaggggacttgagaggtaaacaggggacctgagagccaaggtaaaacagcctaacagaccgcagggctgtgagccctgctgttgcaatcgaatggtgcacctcggtgagtatggcgctccctttcctgtggggagccagctttgataaggagagagaggtgggcaggggacacagagaggcactgagggaagcccatcttcagagatgagcccaggcttagccttgcaagggcttcaggcacatgcggaggcggggcaggtgactgggggtggggggagggaagaggctgctgggccccctccctgctgcttgctcgctttccttctggctctctctgtgtgtctctccatctttctgcctctctgcctccttcccttgtcttccgcttctctgtagccctgtttagaccaagagttgttcacttagggctcctggatccctggagtgtagaaacatgttatctattttatggaaaaatggcagtgaacataggagtacatgtgtttttttgtagaacaatttattttctttgagatatatacccagtaatgggattgctgggtcaaatggtagttctaagttctttgagaaatctccaaaccgcttttcacagtggctgaactaatttacatttgcaacaacagtgcacaagagctccctttcaccacagccttgctggcatctgttttttcactttttttttttttgtagtataagtttaacaggagaaagaggccaggcacggtggctcacgtctgtaatctcagcactttgggaggctgaggcgggtggatcacaaggtcaggagttcaagaccagcctggccaagatggtgaaaccctgtctctactaaaaatacaaaaattagccaggtgtggtggcatgtgcatgtaatcccagctacttgagaggctgaggcaggagaatcacttgaacctgggaggcagaggttgcagtgagcagagatagtgccactgtactccagcctgggtgacagagcaagactccatgtcgaaaaaaaaaaaaaggcacccagagaaataggttgttgccttcactttttaataatagccattctgactggtgtgagatggtatctcattgtggttttgatgtgcatttcttggatgattagtgatgatgaacttttttttcatatgtttcttggctgtttgtatgtcttgagaagtgtctgttcctgtcttttgcccactttttaatggggttatttccttgtttaattgtttaagttccttgtagattctggacattagacctttgtcagatacataatttcaaatattttctcccattctatatgttgttcactctggttttttttattttcgttgttgtttgtttatttgttttgagacaaagtctcattttgttgcccaagctggagtgcagtggtgtgatcttggctcactgcagcctctgcctcctgggttcaagcaattttcctgcctcagcctcccaagtagctgggactataggcacatgccaccacacctggctaattgttgtatttttagtagagatggggtttcaccacgttggccaggctggtcttgaactcctgacctcaggtgatcactctgttgatagtttcttttgctgtacagaagctctttagtttaacaggtcccacttctcaatttttgtttttgttgcaattacttttgaggacttaatcacaaattctttcctaaggcctatgtccagaatgatgtttcccaggttttcttctgggattattatagtttgaggtcttacatttaaatatttaatccatcttgagttaatttttgtatctggtgaaaagtaggggtccattcttctgcatttggctagccagctatcccagaaccatttattgaataggggttcctttccccattgcttatttttgttgattttgttgaagatcagatggctgtaggtgtgcagctttatttctgggttctctgttctgttccattcgtctgtgtctggttttttttttcttttttttttttgtaccagtaccatgctgttttggttatggtagccttgttgtatagtttgaggttgagtaatgtgatgcctctggctttgttcattttgcttaggattgctttggtgatttggacccttttttggttctatatgaaattttaggatagttctgtctagttctgtgaaaaatgacattggtagtgtcataggaatagcattgcatctacagattgcttttggcagcatggccatcttaaggatattgattcttccaatccatgagcatggaatggttttctatttgtttgtgttatctctgatttctttcagcagtgttttgtagttctcctccttagttagatgtattcctactttcacctccttagtaagatgtattcctaggtattttgtttttgtgtgggtaaactggattgcattattgctttgtctctcagcatgaatgtaattggtgtatagaaatgctactggcttttgtaaattgattttttcttttttgagacagagtcttgctctgtcacccaggctggagtgcagcggtgtaatctcaactcactgcaacctctgcctcccttgcccaagcgattctcctgcctcagcttcccaagtagctgggattacaggtgtgcaccaccacgcccagctaattgtacattgattttgtatcctgaaactttattgaagtcttttgtcagttccagaagccttttggcggagtctttagggttttacaggcatagaatcatacagtcaacgaagagagagagttttgacttcttttcctatttggatgcctttcatttctttctcttgtctaattgctctggctaggacttcctatgttcctaactttaaaagccacttagctggatattttttcctttaaaaaatttttttatgaggatagttgcagtctgcttttgacttgcctatgacaattcactttgccccccaggaacccggttaatgggaagttcccgaggatggcctacttaggcatctggagcgtaacggctccccctagcgtcgctgtttcagattgcatattgctcgggtgaggaaggtgagtaagaattccagtcggtggacaggattggctttcagcaggcggtggggccgccaggacaggtggctgcagaggcaggggaaaaaaggaagagtctgatactgtgctgctgagcaatgcgagacttttcatgatttgcctcaacaattacagagaacacccctttgacattcaagggtacagactgcacccccactttgtggcgttctgatgtcttggcatataaatattcccgtatgctgtattatttttcagtgttgaaatattggtatttttgttgacacgatgctgtcattgtggtctgttgaaaatctgggctgggcacagtggctcatgcttgtaatcctggcactttgggaggccaaggtgggaggatcacttaaagccaggagttccagaccagcctggacaatatagcaagacccccatctccacaaaaaaagaaaaattagctgggcatgatggcatatgcctgtagtcccagtgactcaggaggctgaggccagagaatcacttgagcccaggagtttaggctgcactgagctatgatcgcaccactgccctccagcctgggcaacagagcaagactctgtctcaaaataaataaataaataagtgaaacctttacatcttgagatatatttagagatttagacactagcttaattttcaaatgcagtaaacatgtgctcatctaggaagcattctcagatgcctaggtaaggagcaaggacagaaaggaaagtaactgataagaatctctgggaagaatgaatcttagttctcaaagacatttgaaccaacacaatatgaacatcacagcattgaagctgaaacaggtaactctgtgttagaatctccagctgtccatgccagaagtaaagatgataaaaaacaatccagacaaaaactataactaagagtcagtaaaatgattgcagttcctggaagccaagcacaaagcagttgtcctaaaaagatttgtttcaaagttataaaacaagaccaaacacatgtgtaattttaaatggactcagagaaaaaagtcaaagctgttaactctgaggatgccacctgcataacctagcatgtctggagctgagattcttccacccagcagatagttgtgtgtttgcattgacactgtgtttggtacagtaagaggaaaaggtacagtaatgaagcacagagcagggaaagccgtgcctacaacacccagggggcacggtctccaatgaagtagtttccttatttcacctctagggactgg

SEQ ID NO: 1329 - DNA, 2233 bp, Homo sapiens
cgtgagccaacgcgcctggcaagttttctttactaattgcctgatcagcgaaatggggacagtgagttctccactgctcttgaagatggattgtggaggaagggcctcttaggtttcagaaatgtattggaaacccatctgcttttagcagcgacctaagtactaatcataaaaatcaataagccctaagtgatctgggtcctgcgcacctcagagaatgccacttttccctaggaactctctcagcacttggtatcctttttaaaaatggtgtgatggtcaggattgattaggaagcaaggagaacaagggagagagcaacacgtgatcatcgagaacgtaagctctgaaatacttcagcggaggagcgctggcatccccatgaatcatacgctgatttacatacttgaatgttttgttaatttttgcattcaaatttcatgatctgtctgggaagctgcggccttgtatacccggggatatcaccatcaggtgactgaacactaagatcagccctccatggagtttctcagaggaagaaaagccacctgctttgtgtacagtggcgagctcacacatggctgttctgaagacaacttacttaatttgagagtattgtttcatattttagattttctttgtttggtagctgatatggctgcggtctgtccctcaggaaaactaagccgctgatctggagtcggcacctgggctgcttgacgtagaattgggccaacgacaaattatggaggtgccacctcttccccaaggcacacccaggccccgatggcttcaggggcagttcttcccagcaggcactacccaatcagaacagagcagtaactccatctcatttactcaaatactgaaagtgagaacactgaaagatacacaatgcgtagatcctgccagccctgcagagcgtgacaaacagagacacggctcactctgccctctacctgaacagtcatcttaaccttgaggaacctcacatgctccccccgcaaccccacctattctgatcccactgtcctgagacagggacctcaaatcgcgctgggatggaacaggctctgcttcagagggagcaaccaatgcagatgctaaactgggtaccacgcgcttccctcctccagctgacgcctacgaatctctgcggaaacactccactggaattactcactcgatttttctcctgcactacaacctccatcctcttgacagaggtgaaaagtgtggttcagggtccggctacacacactgttccccagggacaacgcaatgactatcttcccaatatgttgtatatgcttagctgtcctagagttatcctccctttactaaaatgttggggtagattaaaaaagaaaaaaaaaaaaagaaaaatgaagcaacccagttcaatgtacttcacagggagatgaactcaggaccatggactaaaaaggacttcgcaggaaacctctggctctctcaatagctcaggtctaaacgtgaaagagtatgatatccctgttttacttctcctccagtaatctacacccctccacctgaaatcgaaaaagataaatctctgatctgtctccaacatcctgcatgtctaccacacttcagaatcagccatgatacagttacacagagggaagctggctttgttttggatccttacccagctttactgccattagggcacatttgtcctcaccggcagactcaaagagataaaatcctagtcgatactgaagtcactggtaggcagcaccatgctcaggggcaaagtggacaaagtaagaacgccggaggctccggggagggcctgacttggtccccagggacccatgcagtttttcccactcctgctcctctgccagatacggattctttgggttttctgggaatgagtctggttttgatcaggaaagtgacaaaaaggtaaataacgagaagtgccagtgacatttcgggtccaatggcagctttcactgcagctggaagaggagtgactcatgcttggcatctcctcccagggctgcgtgaaaccatcacggctttcaggaaggcgatggagccaacacaaaattcaattctgctaactgggtatttgttcatgctattgactaatcttaatttcctcaaaaactccaatcaaaagatgacaaacatacaaccttattgacttcttaaaaataaaatttctcctaaaataactttggaaataaaaatgattttgtcg

SEQ ID NO: 1330 - DNA, 1916 bp, Homo sapiens
agacaaaataagcagcgtctactggcaaagactgtatcatgttgccggagaagtgaagcattaagtagaaactgtgtgtagtggctgtgagggcagcatggttctgcaaagggcttgattggcgggaagaggattagattcccgcatgtgtagttgggaatctgatctgtaaaagccagacactgaggttttgatgtctttctccagttcacacaaagagctaatagctgggctgggactatgtcttaagcatcctggatagttaacatcttaccaacctctgtcttccccaaaagctgcaatctccatatgcaggagccaacatcagtttgctgcaagggaggagaatgaggactattgtatcaactggagtcccatagaaaacaaatgacacactcaaaaggggtgatcaagagttccatggaggggccgttgacaaaggtagagccggtttagagaaaagcaataagggatgcggaagcctcaggatcagcagcagcaggaagccactggcaccgagtgccaaggggtagggagcggtagctgaggtgtggtgagctgtaggtacagaagcactgctattgctgcatcagaggtatcaatattccatcctcactctctcaatgccctctgatcacacgcctggtgccctggaagacagaggtcactggagctgtgtggttgcagtcgttagaggtcagcttcctggctgcagcacagtgcagaaaggaaatggacagagagtggttctggcaggacagatggagactatccagtgcaaaatccatgctggggaaatttaagagttttcttgggagtgcattaaaggagctattgcaggtgccttagaatctcagagtcttaaagtcactcccttccataatccaatagcttgttcttgttctcaggaaagctctataaacccagggccttattcttattgtagtcatcatttccagcagagcacagattcaagagccagctgtttaactcatgaccttgctgaagaggtggtaatggggctattcttagtgatcacattgttatgggttagcaacttgatgttcaaggtagtgggcacctagatatctctgaatgatggtgtttgttggtttgaaagaggtctccctcattaattcattatcttgctggagaggcagttgcattttggcttcagcctttaaatgatagtggctctatttccgacttgcttggaaactattattaactattattcccaacaatacacttgcatatttgacaatctagaaaccaaatttagccatgcaaattatagacaactgctctcttataatgtcactgtgatgtcccagtttttaagaaatggaagattaacaaagccagcttcaaatgcttaaaacaatattttatgtaagaagccattttcccccagagatgcatagacctgtaaaatgtttccagagctctttggaagataaccaatatttctctcaaaggaaggggaagtagcagaacatcaaatatacgcaaaaacccttcaaagctggaagtgccatcagcttactaaggaattatgttaaaaataagggaaacttaagaggtcacttaaatgatttaaacaccatattttccctcttctccaaaaatcccccaagacaatgctcataatgttagactgaccttttagcatatgtgattttagtgaaagacatttctcttcttctaaatatatctcaaaccattcttaaaagtaatgatttctcattaaggctcttgcacctgcttgtgaagaaaagacatctgacctttaaaaaatattccatgggtctgaatcatctaagtatattgtagctttattcttgcagacaagggaaaccaagaatgatctggataatggagaaacctgttaatacaactggatttgaatcacacta

SEQ ID NO: 1331 - DNA, 2050 bp, Homo sapiens
tgttcactgcaaatatcatttttgttgttttattttcagaaataaaacactgtagaatcacaggtgcagttattaataatataccattctcctttccactccatcaataactggtcagcatgtaacattcccatgaatgcttttatacttttactacgtacttatgtatgcctaaaaaattaaaattaatgatgttgttatatgcatttactgcttttacataaatggtactatactacgcccacctttcaatgacttgctgttttctctcaagtataaaacagtggttattgtttttataataattaagtttctactatatactagggtccttgcttacaacttacatatatatattatctcattcagccctgatagtaaacttgcaggtatgtacacttgcctcattttaccaaaaggaaaattaaagttcagagacattaaatcactttcctaaggtcacacagccagtaactgacagagatgagacacaattcaacttcctccctcaatctgttctcccaatcacagggcttttatgtttttctcatttctttcttttttttttttttttttgacatgtagattcaatttcctacttggcatttcatttgccttccctttaaaaatcatatcagatttgtctgcattttttcttcccaagctgtttgctagcctgccctgtgtttaggattggttgggcaagttgcaggacagatagaagggggcttctgaaggcttctgtgaccctatcagcaaatgcctacatcagaaagagtgttttctcatttctggttatgcttctgtaaaagtgggtgttttatggccgggcgcagtggttcacgcctgtaatcccagcactttgggaggctgaggcaggcgggtcatgaggtaaagagattaagaccatcctggccaacatggtgaaaccccatctctaccaaaaatacaaaaattagctgggcatggtggtgggcacctgtagtcccagctacttgggaagctgaggcaagagaatagtttgagcccaggaggtggaggttgcagtgagcagagatcgtggcactgcactccagcctggcaacagagtgagactctctctcaaaaaaaaaaaaaaaaaaagtgggtgttttactatctatcatgtcatgacaaccacctcaaaccttaggggctttaatttgatggtttttcatgttctgcgggtggactgttgagctgggcggttcttctggtctctctcgaggtctctcatgcagtttcaggcagatggcagctgcagctggttggttctctcactctccacatagcttcagggcttctcctttccacaaggcctctccaggtggtctgtttgtgtggtctctccagcaggatagccaaacatcttgcttgacagcataactccaaaaatgcaaggaaggaagctgccaggcatcgttaaggcccagcacattgtcacttctgccaagttctatagtttcgagtgagtcacaggctcagctcagatcccatgtgggaggaactgcagtgaggtgtgaatactgggaagtgcagtttgtgggggccattgtttgaaagctagctaccacaataggaaaactgaagacaggacttcatctcatcctctaaactttcttcctatgaagattctctttgatgagttaatgctctcctaatatacttgagaggcttttaagcaacattctatggcaaggcaggtaagaaaccaaattggcaatatggtatcaccacagtcaaggactgagtcagcttgggaaaccaagattctcaacaaaatattctctccctagtcctacctgctcaacttgttaccatccccgctacaggaactctctctctaaaagcttcctgaagggttagttttctcctaggcttggaggcccatgccaacagatggtagccatagaaatatcagaacatttctccgaattggatttcaatcagctgatgtttaattttagattttgagataggccacattttaccctaccttctcccacttgaaaaatcacaacacagtaatggt

SEQ ID NO: 1332 - DNA, 11831 bp, Homo sapiens
tgaccaagaaataccaaaaatattgatacagttagtgtctaaaatgttatgaatgcatttcctagtttaaaatatgctagcaggaagtatgtatttacagctcagaatagcatacaaaaaaggaatttctgccaaatttttggtaaaaaactagtaaacatgccaaatctgcttgatttccaggatgtctcaggacaatgtatattagaatttaataaaattgaaagagatttttaaacatagatattctagtgtttaaaatagaaaatattgttattaacactatttaatagaaataaaatagaattaaatgaaagaaattgttattaacacaagaggagaatggtgaaattggcaagtagtcatagttaggacagttgattccattcctaagagctttgaactagttccaatatgcaaatttttaagacaatagctaaaagttctcattgtttcccatggctctagtaacttggccaatacaggaagaagctgaatttctgtagttaaaattatacctatcctttgaaaggaaatgggatagccctagagagtattttccagaagactgaatggagaggaatttatatcgttatttcaatgagtaattcctacagcctctaccagctccaaacttctaagtggtaatatgtgatactaacctatgttagcactgaagaaattcatttccctagcataaatagctgcttagtgaaagaactccttagcaccagttcaatgccttttgcacttcactttgttacctcccactcccaactggggtgcacaagacttacttatacataattacttcttgagaattagcttaaaattcaattatagctggctgcaaaagtcatttggtggccaagtatgtcttagtaaaaggaagttttgatatatcacacgtatatcccattttatttgtttcacagggaagaatggagatagattctttacagatcaagagattgaaagtgtcctgttttaatgtaaagttagaatctctcttattccttcttccatggccactttagaggaaaagttgtgacagctcaggcagatgtgtgaatgcataggcctttgatttagataaaccttcctatgttgcaactcccaacttagtgaatctgaccaattttcttaagttaccaaggtctcagcttggatatctctaaaacgaggttcatagtaccagtctcacagaaatgttgcgaagatgaaatagcatatgtgaaacactgaaatcaatgaagtattgagtagacattcaataaatgatagctctcatatttttttctaatatgaaacattaatatgattaattaataatattgattgcctggaggttttttttttaattaatgagctcctttggttttatgcaaagtttatcttagggagacaccagttttcatatgaatgttcttatacacaacttttttttttttgagatggagtatcttgctctgtcaccaggctggagtgcagtggcatgatcttggctcactgcaacctctgcctccaggtttcaagtgattctgctacatcgacctcccaagcagctgggattacagacatgcaccaccacacccagctaattttttctgtgtttttagtagagatggggttgcaccatgttggccaggatggtctcaatctcttgaccttgtgatccacctgcctcagcctcccaaagtgctgggattacaggcgtgagccaccacgcccagcccacaactgttttcattacaaggtagtttaggaaaacaattgggattcatgagacccataggatgctttcataagctttgtcactaaatacagtgagggtgcaatcatgtctcccccagcaggggcccaggactcaggccagaagccacccagagagtgtcagtgctggcacattttgctgaatgggttcaatcaacattaatccttgaatattacttatagagtttatgaggaagaaaatgtgattaatccagacaaaaaagaaaaaaaaaaacatttctcaactgaggggaaaaattcctttgagcataaacagattgcactatttatacacgaaatattttttgcatctataaacttaccatgctcaagtattctaattaatcgtggtggttgccagggaaaccaaactaactcaattataggtctgcgggaaggtgcagtgtatttatgactgtgaatcaggtagttttctgtgcaaaaactaaaactgaacagatgcttgaagattttaaatgttctacagaacacactgttatctagattgttttccttaaagaatctcttgattttctttcttcataacaacttggtttgggaacatggacagtgaatgtgatagattaagaagagacaatgaggaacatgatcagcaataaaaccacaggaaatgactgaattaggagcctatgagttgcattgaaagagagccataattctataccatttctgtttggctaccttatctaaaacgcaaagtctaaataatactgaggagagaggccatttctctcactgtcccgtctccaaggagaagaaagaagtaaaagctgaaaaacaacagactgatcagcaccactagccagacctgtagcttaaagattaacccccaccctaaccacctgtgctatctatagatcacagaaaatggtatggagaaatacttgcattgcttacccccaccgccaacgtatgtggacatagtcaagtaccccatgcttgctcaatctatcacgaccctgtcacgtggaaccctcagggttgtaagcctttaaaagggccaggaactctttctttggggagctcggttcttgagatgcaagtctgccgatgcccccagccaaataaagcctcttccttctttaacctgtgtctaaggggttttgtctgtggcttgtcctgctacatttcttggttccctgaccgggaagtgaggtggttgatggacggtggaggcagccacttaggcagcttaggcttgccctgaaaagcatccctgtggaggactctggctagcttgagtgacgtggatcctaagagtgctcccaggtaggtacttgccccggtggaacacctcgtcggagcagtgcacggcagactcctgcagaggatcaactcagtggctgaacacccagaaggaacttgtgcttggagtctggacatctggaatatggtaggaccggtcctgggaacttgcccactccatttgagtggaagcatggcctgatcacccacggtgtgcccttattggcactttggtctcagttttgatttgattttgatttggcttggcttgtttgaagaaaggagaatgaaaatgagtgaatacttgtgattgacacgaatctcctcttgcagtgtgagtattgttcttttcttctttcttttcttgtcttgggaaggagatggtaaaatgcagagtaagctcactccattaggaactgttttaaagaatttcaaaaaaggttttaatggagactatggagttactatgacaccagagaaacttagaactttgtgtgaaatagactggccagcattaggagtggggtggccatcagaaggaagcctagacaggtcccttgtttcaaaggtatagcacaagataactggtaagccaggatacccagaccagtttccatacatagacacttggttacagctggttttagactccccacagtggttaagaggataggcagcagcagtactagtggcaaaggtacagatagccaaggaagaatcccactccacctgctgaggggagtcagctcctaaagtcctgtccgacccaacatcagaagattaatggcaagaaacagcaccagtgccccccaccctactctttcaccaagaaggaagccctcccactcctgagcccactgcgccagagcttccacaaggcctacatgcccctaggccacccagagtagaaaagaaaggatgtgagccctcgggagaaacccctcccttggcagcccatttgaggtctaaaactgggatacaaatgcccctgagagagcaatggtatactggggtatatgaggatgggcatatggtggaagggcatgcctttgtgtaccaacccttcacctctgacgatcttctcaattggaaaaacaatacccgatcctataccaaaaagcctcaagctataattgattttctctaaactattatccagacctatagccctacttgagctgattgccaccagttgctcatatacctctttaacacggatgaaaggtgaagggtgctccaagcagccactaagtggctagaggaatatgttccagctgattaccaaaatccccaagagtatgtgatccaattaccaggaacagacccccagtgggacccaaatgaaagacagggtatgcaaaggctaaactggtacagggaagccctcctggaagggttaaagaagggagttcagaaggccacaaatgttaaaaagtctctgaggttattcaacaaatggaagagagtccagcacaattttatgagagactatgtgaggcctatcatatgtataccccctttgatcctgaaagccctaaaaaatcagtgcatgattaacatggctttaccatgtgcacatgtttgatgactttgcatcatcaaagtgcagaagacattagaagaaaactacagaaacagactggatttgcaggcatgaatacttcagttattggagatagccaaccaggtgtttgtgaatagagatgcattaagctgcagagagaaccacagacagagcgaatgccaagcccggcaaaacaccgacctgctagctgcagctattagaggggtcccccgaaaggggtgagagaagggggaccccaggaaaaatacctggtctggtcgtccatgcttgcagtgtaaccagtgtgcttactgtaaggaaataggacattggaaggacaagtgcccccagttgaaagggaaacaaggtgactctgagcagcaggcctcagacaaggatgaaggggttttgttcaatctggaagatgggttactggactgagggggaccgggataatgtgcctccaaagagcccatggtcaggatgacagtcgggggcaaggatgttgagtttcttgtcaatactggtaaccactctggtcacccccttatccaaaaagactactgatataatcggagccacaggggtttcagcaaagcaagctttctgtttgccccgaacctgcactgtggggggcatgaggtaattcaccagttcctgtacatgtctgactgccccttgcctttactgggaagggacctacttagcaagctgagaaccgctatctcttttacaaagcatggctctttacagctaagttacctggaacaggagtcatcatggcccttatggttcctcgggaagaggaatggagcctcttcttaactgagccaggccaagagataggaccagcctggctaagcggtggccaaaggtgtgggcagaagacaacccttcagggttggcagtcaaccaagcccctgtactcatagaagtgaagcctggggcccagccggtcaggaaaaaatagtacccggtccccagagaagctcttgagggcatccatgtccatctcaagaacctgaaggcctttggaattatagtcccttgtcagtctccatggaacactcccctcctatctgttcccaagccggggaccaaggactacaggctggcacaggatttgcccatggtcgatgaagctacagtgattttgcatccaatggtacctaacccgtacacattgttggggttactggcagctaagacagctggttcacctgcttggacctaaaagatgctttctttagcatcagattagcccctgagagccaaaaactgtttgcctttcagtgggaggatctggggtcaggtgtcaccactcagtacacttggacccggctcctccaagggttcaagaactcccccaccatctttggagaggcaatggctcgagacctccagaagtttcctgccagatacctaggctgtgtgctgctccagtacattgatgacctcctgctgggacaacccacagcagtcgggagtgccaagggaatggataccctgctccagcacctggaggactgtgggtataaggtgtccaagaagaaagctcagatctgcagatagcaggtatgttacctgggatttgctatctgatcagatagagcgcagcctgggatcagaaagaaagcaagtcatctgcgacctgccagagcctaagaccagagggtaggtgagagaattcttaggagctgtagggttctgcactttgtggatcccaaactttgtagtattgcctaagtccctgtatggagtcacaaagtggggagataaggaacattttgaatgggggtcccaacagcaacgagctttttatgagttaaaaggaaaactcatttcggccccagccctggggctacctgacctgacaaaaccttttacactatatgtgtcagagagagaaaaaatggcagttgcagttttgacccagactgtggggccctggccgaggccagtggcctacttctctaaacaactagatggggtttctaagggttggcccccatgtttgagggccttggcagcaacagccctgctagcacgagaagtggataagctaactcttgggcaaaacctaaacataaaggccccccatgctgtggtgactttaatgaataccaaaggacaccattggctaatgaatgctagaataactagataccaaagtttgctctgtgacaaaccccatataaccattgaagtttgcaacaccctgaaccccaccaccttgctcctggtatcagagagcccagttgaacataactgtgtagaggtgttggactcagtttattctagcaggcccaacctccgagaccatccttggacatcagtagactgggagctgtatgtggacgggagcagcttcatcaacccacaaggagagaggtgtgtgggatatacagtggtaaccctggacattgtcactgaagcaaatcattgccccagggcacttcagcccagaaggctgaactcattgcttcaatttgggccttagagctaagtgaaggtaagactgtaaacatttatactgactctcggtatgcctttttaactctccaagtgtatggggcattatacaaggaaaaaggcctattaaactctgggggaaaagacgtaaagtatcagcaagagatcttgcaattattggaggcagtgtggaagccccaaaacgtggcagtcatgcactgaagaggacaccagcgagcttccacctcgattgccttggggaactcctgagctgactcaaaggctcaaaaagcagcatccaccccctaccaggtgtcagtcccagcccccctgctccctcaggcacctgaccttgtgcctacttattctaaagaagagaaggactttctccagatagagggaggacaggtgatagaagagggatggatctggttaccagatggaatagccatgccacagctgctaggggccacagtcgtactggctgtacatgagaccatccacctaggctaagtgtcacttgaaaagttgttaggctggtacttctacatctcacatctgtcagcccttgccaaaacagtggtgcagcagtgtgtcacctactggcagcacaatgctaggcaaggtccaaatgtcctgcccggcatacaatcttatggagcagccccctttgaagatctccaagtagccctcactgagatgcccaaatgtggaggtaacaagtatttgctagttctagtgtgtgcatacgctgggtgggtggaagtctatccaacacagaccgagaaagctcatgaagtaacctgtgtgcttctccgagatctccttcctaggtttggactgcccttacaaatcagctcagacaacgggctgggatttgtggctgacttggtacagaagacagcaaaggtattggggatcacatggaaactacataccacctaccgactacaaagttcctgaaaggtggagcggatgaatcagactaccaaaaatagtttaaggaaaatgtgtcaagaaacaggattaaagtgggtataagctgtccctatggtgttgtttaacattagatgtagctcttctaaaataacaggatattccccttatgaaatattatatcatgggtcccttcccatactaaggggactcccaggcactccttgagagctaggtgaaattgagttacagtgacagctacagacttcatggaaaattacacaaacaatttcagcctaggtaaatgagaggtaccccatcagcttattctccccagttcaccctttctcctcaggtgatcaggtgtgtatcaaggattggaaagtagcccccttgtggccatggtggaaaggaccccagaccatcgtcttgaccactcccacagctataaaggtagagggaatcccggcctggatccaccatagacgggtaaaacctgcagcacctgagacctgggaggcgagaccaagcccaggcaacctctgaaaagtgacctcaagaaagacgacaagcactgctccagtcacaccagaaagatgactggtccctgcacagccaaagcatgaggaaactcatctgggactcattttccttaaattttggacttgtacagtaaggacttcaacagaccttcctcagactgaggactgttcccagtgtatacatcaagttactgaggtagggcaaaaggttaaaacagtctttctgttttacaattatgaatacatgggaactctaaaaggaatttttttatataatgacacccagtataaggtatgcagtccagaagatggacaacctagtgtttgttataacccatctgaaccccccatggccacagtatttgaaataaggtggaagactgggaactggggaaaagccaatatgagtaaagtaataactagaagagaagaaaaaggagtccctaaacaaattatcttaaaatttgatgtttgtgcagcaatcaacagtgacccacatggaaatagaataagatgtggctctctagattgggaaaggagatatatagtagaaaataagtttgtttgtcatgaattaggactgtgtagtgatgaatatagttactggtcctgtatcatttagtccacctgaaaagaagatgagaaggaccctgtccacctttaaaaaggaaagagtaactcttcctgcactagtggtcactgtaatgcattagaactactaattaccaatccccttgatccccattggaaaacaggagagtatataactctaggaatcagtggaactggactgaatccctgagtaaatatttcagtccaagcggaggtccagatgcactctcccaaaacagtgtttcagaccttttgtgataagctgaaatctgccatcaccagagcttccaaaaaggaaaaagagatgaagaacttctttctccagttagcagaaaatgtagctcattccctcaatgttacttcctgttatgtatgtgggggaaccactgtaggagactgatggccttgggaagcctgagaattggtgcctactgatccaggtcctgacataattccaatccagaaggcccaaactagcaacttctgggtctttaaaaccttgattattggacaatactgcatagctagagagggaatggacttcaccatccctgtaggaaggctcaattgcctaggacaaaagttgtataagagcaggacagggacagtcatctggtggggtctcaaccgcactgaaaataatccattcaataaatttcccaagttacagactgtttgggcccatccagaatctcaccgacactggacagctcccactggactatactggatatgtgggcatagagcctacaccaaattacctgaccaatgggtaggtagctgtgtcattggcaccattaagccatcctttttcttgttgcctgtgaacacaggtgagctcctacgtttccctgtctatgcctcccgagaaaagagaagcatagctataggaaattgaaaagattatgagtggacctccaaaaggatcatacagtactataggcctgccacatgggcacaagacagctcaggggataccaaacccccatctacatgctcaactggatcatacggttaaggctgtcttagaaataatcactagtgaaactggcagagctttgactcatttggcccggcaggaaacccaaatgagaaatgccatcgatcagaagagactggccttagactatttgctagcagctgaaggacgagtctgtgaaaaattcaacttgaccaattgctgtctgcaaatagatgatcaaggacaagtagtcaaatatatagttagagacatgacaaagctggcacatgtgcccataaggtttgccataggtttgatcctggatccctgtttggaaaatggtttccagctctaggaggatttaaaactcctatactaggaataataatagtgttaggaacctgcatgttactcccttgtatattacccgtatttctgcagttactaaagagtttttttactaccttgtttcctcaagagacctcagcacaagtgtattacatgaatcactatcaatctgtctcacaggaagatctagatagtgaggatgacagtgagaacacccactagtgagtgaggttctccaaggggggaatgaggagcgaggccatttctcttactgtcccctgtctccaaagagatggaggaagtaaaagctgaaaaacaacagactaactggcaccactggccaggcctgtaagttagagattaacccccaccctaaccacttgtgctatatatacatcgcagacaatggtatggagaaatatttgcattgcttacccccaccgctaacatatgtggacacagtcacatacaccatgcttgctcaatctatcatgaccctgtcacatgggccccttagggttgtaagcctttaaaaggaccaggaactctttcttcagggagctcagttcttgagacacaagtctgctgatgctcccagctgaataaagcctcttccttctttaacccagtgtctgaggggttttgtctgtggcttgttctactacaatacaataagtaagatgggagcagctttaacggaaaaaaattaaaaacatagaactagtgagtttagctaaagtaactgttagaggaaattgtggaaaattgatgacatttggctaaaggatgcaggaatgtccacacctgcatctataacaacctttcttctcataaacatctcattcactacaaagaactactagaaaatgagatcaatgaaactcaagggagaaagtgtgatcaggtttgagaaagtttctaacatggcattttcattagtaaagcacttgtaattattattgttaaaaactacaagttatgtaattgttttcaggaacaatataatcttatttaccatataaacaaaattgactgcttttctgaagcccagatctaccatctgcccatccattaatccacccttttattcaattaaaaattatttattgatttccttctctgtgcttggtcctgtgctagatcttcagtatacaataatgaatagaatttctacacagtgaatttataatatgaccagggaagcaaatcataaactgataattatagaaataaatgtttaataaattagacctttgggagtaggtcttagaatgacttgatgggagctcaaagcttagtcttttctgtctccataaagaatccatcctctggatgaattaccacttctatcattaat

SEQ ID NO: 1333 - DNA, 1339 bp, Homo sapiens
taatcaatgaaatcatatagttttattgtccattcattgtctatagcatttttaatataaattaagatacactttcatagggggaaaaatgtccaatgatttagaaatagctatgctatggacaataaaatcatggttttctgtgtttgagtgtttgactaaatgttagactagaatataataattgtggcagcataacagaatgttttcaacttagtaagctttgacttttgttgcaaacatcaggaaattaatctctaagtctaaactgtgataggtttacacctgagcagcctcttgctgctcaggtcaggctataatgatttcgacttgatctatttctttacctttagaaactccctactttatttttcactaaatcatcaaaaaccttgtgccctttgttacaccaaacatagagttgttttattattagtttgcatttatattgtattttccctcaagtagcttgaggtgctttacagaacatgacagcagtcatcaaaacactttgtcaggtaagtaaagtgagaaataatgctgttataaatgtgctgaaggcattgtacttgctggaaaatgtttattttctacatattttgttagatacaatcttttcagtgattttgtttaaaatgagttccaactcattaacattttcttttcttggctttagaatcagacacatttgttcaacaagtttattgggcatctgctctttgccaagtattcttgtagggactgagaatataactgggggataaaaagaatttgctctcaaagagcttttattctggggaaagagacataatatataaataaataaatatacactataattgcttgttgtattaagtgctatcaagagaaaaaaacaacaaaataaaaggaaataaaaggatagagagtaacttcatgagaatggaaggagttgagaggccttggtggcagaagagagcacaaatatgggggaatgccaagtctcccagataggaacatgtttggcatgcacaaagaactgaaaggatgccgagtcatgttgctagcacgccatgagccagtagaggagagccgaagaaagagcaatggcaagatcctacaggaacgtcgtgtaggtcataacatgatttggatttggtctcagtataatggaaacccattggatgcgactgagcataggggactgacgggatcagaaattactgtgtaggggacaagagtgaaagtaagatgacccacagagatcatggtggtccaggtaagaaacaaaggtggtggccaggtgcagtggctcatgcctataatcccagcactttgggaggccgaggcaggtggatca

SEQ ID NO: 1334 - DNA, 1785 bp, Homo sapiens
taaagttgatttctttgcaaatctattccattaaacaattttcattcataatatgagcccgtattacattttgtaaccctaaaaatcaccatcggcatcttctattcaacagataataagttgtaaacagagcaaaaactattacggaaaccatgcatataacatgtaaagtaacagtatcaaataaaataaaaaatgaccaaaaatattttaaaggtacagtagaacaggccaatcacaaaataaaaactccaagatagacaatcatggaaagaaatggtactgaatgtcagctccaagatgcatcaatgagtaaaaagatgacttgtgcccccagctcccagcacaaaggccctggcaagcaacttggatgagttcttaatttactcacttgctatgaagtcaattcttaaagaccgtgtgtgggtttttacactctgtatttcaccaaatattagaatgtaagacaggaagacaaacgttgagattcataacaatagcattcacatctacatatggtaatttcttagagctattcaatgaaaacttccacctcggagctgacatcttagaattattttgataccatcccttgcgattctgtaagcaaagttgttaagagtctgcaaaggcataaatgcatagagcagttgtctaaaattcttgagagaaaatagtaaatgttctgggactccatgcagatgaaaagcaaagtggcagaactacttttaaagttgttcatccattaggctaatctctaagccaatcaggttctgaggaaagcaattatgagcaaggtggacagagaacttgcctaagacggaaaggagaattcaacagtatctctgattaagtgctttaagtgctgtgagaacaaatctacaggtgcggtgtgggtttggcagggatctccgaccttaactaggaaaggggtggggatccagaaaggcttcctggacgaaggaatatccacggggaaacctgaaggattagcagaagttagcaaagtggagaggagggaggactgttttaaggagaggaaatagcttactcagactcagaggtgagaaagaacatggatccaagagaaaataaaaattcagtagggatgaatgaagcctgaatcccctcgattgccgaaaggcaagaagtgagcctggagatgaagttagggaataaggcataaaatctaaagtaagtttcattaaagcagttttacttgagacaagagtctttgagattgatgtttcaaagaaactgctccatgcaaaatggactggaggaatgcaggtgaggtaggcggatggctcggattggttatggcagtggagatggaaagaacttgatgcaggtggggtggatttagaggtaatatcgtcaaggcctatgagaaacaggatgtacagaatgagaagtaggaaagagtgagggaccaaagtgattctcgggtttctgatttagacagctgggtgcatggtggtgcagtcactaagaaaaacatcaagggaagggcagtttgagattaacagatggatacgttttgggcaaaatgggttggcaatacttgtgagccgtccaagtactatgtcctgtaagacatggatccgtgtagatccgtggatctggagctccagagaggaacctgggatagagatggagatctgagagtcatgagattacaattggcggttgaattttattgagtgggtgttgtctctctagaagaatgtgtgtcgggagaaatgaccgagggagaaccctacagagcaccataaatgtgtgatg

SEQ ID NO: 1335 - DNA, 2128 bp, Homo sapiens
tctccttctccttatatgtgcactaattccatttgtgagggctctatattcataagctgccacaggccccaactccaaataccatcatattgggcattagtcttcaacatatgaattttaggggagacaccaacatgtagttcatagcagcttgatatattctgaatgccattaaattaaaaaaataaggagacctaagtttattttgcagatcggtatagtgattgtaataagacaaaccatcctagtattgaaagccctgcatcctgagaaatcccctagtcccagaaaaactggaacacttggtcaccatatggttaggatgactagtatgaagccaactgctctgaataagatcccagatccaccacttattagctatgtgaatttgtcaaaattatttcatctcactttttctcaattatcttatataaaaatgagaatagtgtacgtacttaactggtaaggttataataataaatgatgtaagacatgtaaagaactcaaaatggtgcctagcacatgtcaagcactaaataaatattacctaataacaaaaacaataatgttactatttttaagtggaaagatgatttattgtatactaaagtaaacataattgtgtaaatgatatcattttgtgttggaggttgattatgtcaaatgggacccatggatgctttaagatgtcagctgagtgaaaatcaaatatttaaatggttaattctataaactctgcagaaacagctgccagggaaagctacaccccgtgtttatcagtgttgtagacaaagcttgaataaataggtgctattaaaacaatccagtaaacaaagctattttcatatctgattttaaaatatgaggtcatgttcacatagatgaaattcaaatgaacatcaggtatttatcgttgacaaaataggtcataaaatgtggaatatggagaagtagagacaggggttactaagtttgaattgttccagtacttattacttttatgatattaggaaattcctagtcttcctgaaattgaggattgtaaaaacatacagtggatatctgcttctttttgtttgtttctttgctatacaacttgtgaacatccttcctgccttttagtaatctcctagcaagtgggcactggtcccattatggaactgaagtggccaaatactgcttcctcccgcctcgctgtggttataacagtagtcatgaaaccttagcatgaatcaaaatcacatgcaaaactttttaaaacatagattgctgagccctatccccagggggtttgagaatttgtgtttctaacaaattcccaggtgatcttgatgctgccggttggggactataccataagaactactgagctagaatgtggggacatgatttaggtcaatcaaagagatgaagctatctgggatttgagataaggatacaaacataaggctagctgagaaattatctgtggatagaacaagcataacaggaatccaactctagcaacgccaagtgttcaacgattgttatcaaagcaggtagcttttagattgttgctgtgaatgaccttggctgtctaggcttccttgattttttactgtttcctggagactaactccatcaccttctgtcagtctatgagccacgctatgtctcttcagtaaattacctgtatgggtaagctcaccactgtcagtttctgttgcatgcatctaggaactctgactagaggagcaatgttatcaatgagtaagccaggacttaaactgttgtcagccaggggtgtcagtaactcaagctttgacaataactgagtaagtgatagaggaatgctctcagtactatatgagcacagaggagaggatttaatccaagtgactggcaattgagggataggaaatgggggaagagtatgtttgaagaggatgttcaaggcagataatagcaggataaaatgagagctgtaagtaggaatgaatttatggaaaaccttgtgtgcccggcaagggaatttagatgatcatctgcaggtccacatttcctaggaatcactctggagattctaaggtaggaccccataatctaattttttaattaatcttatgatcaagcagacttgaaaatactg

SEQ ID NO: 1336 - DNA, 2183 bp, Homo sapiens
ggtagcagatacccggtgtaatattcattgaattaataagagtttaaataaaagatgcaggatttaaacttcaaacttctcattctttcacttccaacagtctgcctatagcatataagccctttggatccctctgaaatgtcacttcttcacatggacttttcctgacctccctatctacagtagctgtctctcctaccttccactgccacccatcattctgtacctcagcatcctgtcttctttccttcgtgacacttatcaactcgttttctcatccaccctccctcccttcctttctcccatccttcctttctcccaactccttccttccttccttctttccttccctccttccttccttctttccttccctccgtccctccctcccttccttccttctctctctttccttttgcgatttatctcatccactcctactgtggaagcaccatcagcatgagggaagcggcttattccctcctgttcttgatagcgcacccatcatctaactcaatgcagaagcacaattagaataatactcctagtgcttacttttaggttaaaatactgcgatgagaatgcaacatttctggaagcaaaagatacgtctgattttggaaaatgcatggttcttagccccagtggaaaacaaatacatcactcttgcccatagattagggcagttgtgagatacgatctcaacaatatctcactctgtctttcccttttcctggtcagtctgaaatatactagctaaaggtagccatctatctgccttcaggaagaatgcagttatgtgaaaccatatgctattaaagcacaaataactttctcctacatgattcacaagcttggtaatcttatataaaaataatgtaaatcaccctagtgctaatgaaagagtaaattattaagtattataggtgtcagtatgcctaagtgggttcattttattttctggaacaccaaacattatttctttctctccaactgagaatttatatgcctcagagtagaaattactattttaggagctctcagaggatgagcatttgtttaccaaatacacaaccactctcttgcacatccaactaacattgaattgggttgtctctttttctcctttttgacatgacttgacacattagaatgtgacaaaagaatttatatttggcagaaattcttgctccatatttaattaccctgtccatactaatgccacatttgaataaacaaccaatagcccaaaaccctggagaagattttaacataatgtatgaagattctgtcaagtccacctttgaagttgtctcctctaattattagaaacttaccactggtttcagtataatcactatgggagttagaatgtattacacagcaatttcagttcatggtcagtagtcatggcaacacaggaggataaatcttaaaataagaaataatctccaagggcaagagtttgcatcttgcttccagatgtttgcaatttcatttttggaaataaataagctatttgggtttttaaaagccttaaaaatctattttgaaggtacaatgtttaatttttttttcaaagtgaaaaactgcaccatgttttctaaatagcaccgtatgctaaattttctttatagctttttggatactttaaaaattttctcatttaagaattacaccaatttttttctctaattcactcagtcaataaaaatttattgagcacttgatttgtgccagacaccttgctagacattgagaattcagagattattttcttttgctgactttgaatatgaacaagggatggttctatgtatgtagatttaggaaacattaatatttgctatatttgtgacacaaatcctcaagaatcagaagtatttagttgaagaaaaaataaagagacagaattattctttatctgtaatatgcatagaataggatataccatatataattatatttttagtttacaagcaaatttaagtaacaattttaattatttattgcctggtactattctcatccactggtacctttgtcctggaaggaaaaaccctgtgtcatgcttacggaataacatcaagcattgtgaagacatcgagttagtaaaatgtgggtacttttagaaatgtagtggaacttaggtgattctgcccttctgcttctctccttgtacc

SEQ ID NO: 1337 - DNA, 1740 bp, Homo sapiens
tgtaaaattgatataaaataatatatgttataggagtattgagaggcttgagtcaacaacggtaaggtctttagcacaacgtgtggtatttaattagagttaaataaatattggtcatttttctacacacaggaacataaatggatatgtcagggtgatcccattgtccatacaaccaaagtctctgcactggtatcatcaaattggaatatgagaaaacaggaagacctaactcccttaacatcattatctatttgcttaccttgattttcatagtacctgagttctctcatgcttatttatgcatttaggcacattaattgttaaaaatggttttaacatgtcagttggtttataacccatatttctttgccattcctttccgtatcctacacttagtcccctagtttcaagacaaaacaaaagaaaattgaaatgagatagtgcctcaccagcctgccttccctccccagggtagcaagacaaataaaggttttgttgtttgtctcaagttagcatcaacacagcctgcagcagccctgtcagcaccagcccgtgatgccagggaattgctgggagtgccagcatgctggtgccaatttgctgcctgggctccttcaaaaccacatcaaagtatctgccagtttctaaacttccttccaaggctcatggaggaacatggggacctctagatgggatcagatgtgtggtttttcacattcccccctccatctcctctgcctgccaacttgggtgagcctccagtattctctgtgtccacaggactcttcggttgcctataagataacattcataatagttgaaacctgtgatagtttgtgagaaagatccaataaattatataatttatgtatcttctctattacaaaaggcctgactcctacaaatatttcaaaatttaataaataattctccaagaattcaaatgcacatagtttgttttggaggtacagaaaataccattattgagaggcttattggagtggtctagtgataaaaggaagagaagaaagacaacagtttattaagtcatcacagtggacaactaaattctatgggaaaatgctgtgaaatagtgtaaaacataagccacgtgtgatggctcattttatatgtcaacttggctaggctatggagcccaggtgtctagttaaacgctagtctagttgttgctgtgaagtctacaatcagtagtcatcaaagcagaagactacagcatagacaacatgcctgaatttccagcctactggagtgtcctgaagatttcagattcaagactgcaacatttaactcttacctgaacttccagcctgctggcctaccttacaaatttaatacttatcagtccctacaatcacataagcaaattctgtaaaatcttcctctctctctctttccctttctttctctctctctttctcatgcatatgtgttcatggttctgtttctctgaagaatcctgtcttaatacaccacacaagaagtaaagatgctaggttagtgatataccaatgccctccaaacattggttgacagctgtgctcaggggtagtagagccctggacatttctagactgttgcatgcacaagcagaacatctttttcagctctggaaaaagcctaaaaagcctttaggcacagaaataaatatattggtgattggaagtgggctggagcatgccaaagtggtgggtccaagggatatgagtgaggcagtaa

SEQ ID NO: 1338 - DNA, 1460 bp, Homo sapiens
tggaagcctccagtactaagctacccagacagaaagcaacatccaggtcaaagcatcactgtccgaccacatgacccttctacacctgggccccgaaggcactgctaggagtcaacagctccacctggtgaccagaggctggccttcatcaaaggctcaggcactgcagcagttgagaatttctctttatgggtatttcctcaggcataaatacagtaactaaaacatatgttttcattgtctgctacttatggaataaacattaatgttttgtgttttcaaagctatttaagtcaaaaaaatcctttaataatgtttatggagaactgaaaaattgttactggaggtctcacaaaaaaaatcacagtgaaaaaacaaataattctgtgcaaaagtctgtttattaaacctatattcatcttacaacaaaatcagaagttaataactaaggtgtcactgatttcaagactatttccatcaaactttaaagtttgctcatttttcatttaattaataatttaatacccacccccctaccaacacgacccatggggagacaataagtgtaaagctctgacaatataaaatgctgtggaaaataatcctgtcagtcatattgatagctagaatgatttgccagtttttatagccatcataacagcagcctgtgatttgaaatctcataaaacaggaagctgtgtgcttaaagacatgcctggaattcctgatgtgatgggagacaattgttgtgatctgttgctgccaccagcaggccattctcacaaaatggtattttcccctttgctttttgtttccaacttacctactgatatttcttgaccaccacattctttaatcaggataaataattagataaaaaaacaaatctttttcatgggtatcctcagtaacaatcacttctttaaaatctaccatatataacctttttaaaatttatttaacaaacaggcctaatctttctgcttatcttttattccttttttttttcataagctcctaaatccttgcattttttaaatcaggttcctggtaaatatatcttaatatgagaacaagtgatcctggcataaaaggtagaagcccacagttcatcacactgatgactgctataagatattccttaaattttcatttagctggcgaatttaaggctggtgcatacaaacaagttctatagccacatcaacctgggatcagatccagcttcttagcattgtgctcttgggaagcatttaacctttctaggcatcagtatcctccctgtaaaatgaggataataataatacccatgtcttaggattgacaagaggaataaatgaaataatgcatataaagcatttagcaaaatgtctggcacatagtaagccatcaatgaatgactcattattattattaaagtgtaaaaattaagacttccatacaatcagaagccaaatcaa

SEQ ID NO: 1339 - DNA, 2304 bp, Homo sapiens
ttacagaagcccagcatttttcaggctagtcaagtgatatagaaaaccaacatttgtgatacttgaactgaaaagaatttaagtaaatttatcttgaaaatttggggggatgaattggactaaaatattagatggaagagtaatcacagacacacacatacacacacactcatacacacacatacactgaaatacacacacacacacctacacacatacactcatgtacacacatacattcatacacacacatacacacacgtacacacactcacatacacacatacagacttacatacacactcacatacacacacacacagaagggaaaattttggttcatccccctccaaagactggtaaaattagcaagaataaattgaacactaggtgagcgtggtgtagtgtatgccacctctgttctcccaggagccctacaaggtattagtgataaataattgtttattgcaacaagatggagtcaatcacagtgcaggcaccttaaactatgaggctccattttaacatctgtcagtcatcatccaaatggattgaccaggaaacaagatagatcactgcaaaagcctgctttctgccccactccccttttgcttgctaaaaatggagaaagtgttttggagggctgtgtgtgtgtgtgtgtgttgctgtgggggtcaggcagctgctttaaaaattcagtgcttttccttccattttggtgaccagaagggtgggaagcagaagttggagacaagaaggaatttcataaaaacagcccatcaaaacaagttttaggatggtagtggagggaggagatcacccagaaaaagacggttccaggaattcccatctggaacttggtttatacttcttgaatattcacactgtttcttaacttccaggaaagtctctgcattagcagccaactctggcaagcactgtctagggatccagggagatttattgcaaagagagagatgagagatgccttgtgtagcttttcagatggaccacatcttctcatgtcatcatgcaggctcactctccttcctgaacccttccctgagccttttgcactcacacctgggaagaaaggggattagaagttccagcaaaaacagccgcaaatgatgcgtgttaaggcctctatctaccagacaggaaggcggcagcataactagtcaggcccttgtgattcggggattcagcaagaggcactaaggctcccagacaagagtctaagatccactgttatttgtggaaccctgatcctgcaggttgctaagccattttcccccgttccccaaactttgcaggagcttaaggcttcatcacgcaaaaggaaaggatccctgctttacactttgcagagtaggaaataaatggcttagctttccttctaggataaagaagatttggacttggtcagtcatctctaatataatggcatgccttccctgttcccttaactacacccaccatgcagtccattcctgaaaaggagattctaggcgttccacatctattgatacagaagtcctgtgctttctcactttctgctcgcctaactctgttcttggacgtactgaattcctaacctctcggtattgtcttccttttcctacccacttctaatctttggacctttattcatgtttgtttattcacttattattgatttctaccaacaatatgagtgctgtcatgtgtaaatgctgtgccaaagatgtatgtgatggagaacaaaacaaagaaggttcctgtgctcttatgatttacagcctagcaaggaggaagacagtcaataaagaattatccaagcacttacagccttctgaagtggtgagtgctgtgaaggctagtggctcactaaatataaatagaaagcctattagtgccaggctgaggacaaacagggaacaagacagagccccttctcccatccctattttcatggaaacagacctttaatcaaacaatcacactcatgaatggtacaatctgagtatctaacaggggagcttaacatatgcctgagagtgattgggtgacttctgggaggaagtggcactgaagcagagacctgcaggtcaggtaagaggtgatggagccctgctaactctcttggcttctctgccatgtacccaccagtaggtgtgactccgggcacctctccacggatgtgaattctgcacctgccttttgcctttatctggtcttgccaatagaccacacagactagtccaaatgctccctaggactacaccaatgcatgagcctacctgaccagcatccctggcccct

SEQ ID NO: 1340 - DNA, 1739 bp, Homo sapiens
tttgagccattccattgagggacctgtcctaggaaaaggctgaaaattagacttattttttcagaaaaatgagtcaacgtacttgagcaagacattgtcagacatcagccttgatgtttggtcaaatggaatattccgttactattgctagtgagggttcccattaattgacacccactgtgtgctcagctgccttctaagcacgtctactaagtcacttcaacttcatgcccaccctgtgaggtaggtacagccttgtccccattttatagagggcaaaactgagggccagagaaaatgagtaacttgccttatgttcctcagccaacagctggaagaccttggaggccacctctcaactgtcaggccagtgcctgaccccagccactatggccctgccctctccaacagtggcaccaccagcatagcccagaacaaacagagtgtggtcatttcttgattttgtgtgggagtggaaactaatccacaatgtattcattcagcaagaactttagagagccctctttgtgctaggccctgtgctagtctgtgtagatttgccagaatgtccaagacacagcccctacctaatctcagttaataaaggtgagaaatggacatagaaacacctgtttcatgagagtagtgcacacagaaaccagaggagctaggagggggagaggtggcttttccaacatgttgtctgattcagaaccttcccaccaacctacatgtgcaagccaccttcccatttattttaaacaaagaattctgaggctcaggaacctgccagagttcactcagccagtgtctaaaattgactccaaagctccagccaccaccttcgctgcctcctgatttctgtcaacagtttccaactcctgatgattagggatgactttggagaagaggaaaaaattgtgaaatgtcagaaaggtattttccatggttcggcttggttaaaatttttaaggctgctaagcattgcattctggttacaatttaagatccagaagaggtatgccctcacactctgttcagattagctgtccaaatgcagatatttgaatgaatgaatgaacgaacgaattaattaactaattaattaatgagtgaatgaatgaaaatattgttgtcgactgtttccctctctcctgtaccagacccttaccggcagggaccatatatcattaatctctgaatccctagtttagattcagagcagatgctgaataacggtttattgaacgaaccagagaattttaaaagatagttgggatctggtatttcaatccttttgcttgtcctcatttttttcccatcactcattagctccaatggttgacagcagcgagaggagagggattggatacagtttgcttcctgtgtatgaaaagctcaagagaaaggcctgttggagaatctgtcaccagatatttactggtgatgcttctcagggactgcccgttagtctgacttccctcatgcctaacagggagttaactgataccacttccacttacttaattctggagcttctcaccctaggaattctcactgtgctttgggtgacttgtggaggcttagccaccatgaaatccagccccctcattttcagaggaaggatgtaggtcccagggagatgaagtcactagcccagagacattcctaataagtgatttggttcattcatccatcaagtatttgtggaatgtctgcagtgtgccgggctctggaag

SEQ ID NO: 1341 - DNA, 1878 bp, Homo sapiens
tgtggctttgacaatcctgcagcaaaggtagtaatttaatttagtttaacatagcacccattctcctatttccaatgtccacagcatcaaaaaaaaaatgaggttcagaggaattccatagatcctctcttagtaagtttaggaagtttaatgattcccatttgtaataaaatctgttatgggtcagtgtattggtgttcctgaggttataaacatacccttctctttaccctagacattcaaaaccaattgagaaagaaacccagacatcaaatagggatcaaaatactacctcaattgctggtgaagctcaattggaggaagctgtttggactagagtccagattgattttcaaatacttccctctgaatcatatggacttgcccactcagctgcagggaggagaagctctgctcagtggttacttccacttgcacatcagagcagaaagaagaatacaaatgttctgtgggcaggtagacccaaaggaagaaagaccacatgggaataagagctttggaccttagcccttcccaagtgaggaatgtaaacatgatgccgtactctaataattccaccaaaagataatcaagcaatatatgggaggaagaaggtttggggagtaaaggaaaagcagaaagcctaaaaaagataggagtttgaagattcatttatgctgggacaaagggagaaagagctgcttgttccaagtgctgagaagtggtctgtagtctatgtttggcttaaaggttgatttcttgatgtttaggagagtggagagcagggctttaattagcctggatattaagaagatggaataggaaagacgaaccattttcttcggcgcccaggcaagaggaagtcttaggctgcggtgggggcgtctagtagtcctatctgtactgcattgttgacttgacttgccaatatttgtttctctattttccttgcactctaaatagcgcggtcatgtgtgatgtgctgatgcttagctgtagagggtgaggagcaggagaagatggaggccagtgacctcaggctgaaaaagatcccccaacccttggaggattgtttctattgtgggcaccgttggcatgccccagggtgggcaggaagcatgcaagaataatgcctccattttcctggggcagtcctacagccttgccctcttgccattttgcccttgaacacttagcacatttctctgaagggctatgagaggctggcttaatagggatgggctttacacagtgtggctctgaattattcctgagtcattcttggttcagagaagccaaaggaagaggaattaattagcatccttggaggtgtatttcctagactcagctgactcttgcaggtgaaatattaagattctcaatcactgtttgttgagttgtgatatttgaatctcattataatgcttgaggggactataatgtacaaaattaggggctaacacagaaacatccacctactatcacaatgagataaaggtttccaaaacacagtatgcaagaatgaactgcctcccgtgagactgggagccagggcccatccattcaggccattagccttgcttgagacatttttgatccagaagaggattgttctttttctcctgaacctgagcattctgttcctccaaggctgagctaatcctgtgcataaatagagaaggtagccaattttgtgggctaattgtaggggttgaggttgagtggaaaggaagtagacgtggattataaagtgcagcctatgcaaatgtatctactaaaggctctgaatttaatacatttaataattccttttggttaagaaattattttaaatttcctttagatttctctttgagaggatagctcattggtactgtc

SEQ ID NO: 1342 - DNA, 6413 bp, Homo sapiens
gcagaaagaaaaatgtaggaagagatatatcatgcaaacagttaagtctaagacagctgttgtagtcatattagtgttagaaaaagtactaagttgaagacaaagagataaagaggcattttataatgataaaagtttccattcatcaagaatacataacaattcaacatacatatgcatttaagaacagagtttctcaccatcttatacttttgtataatgtgaagcaaaactatgaaacaaaactaacagaactaaaggggaaagagatgaattcacaattatagttggaaattttagtgctgctctctgaataaaaaataaaacaagtagacagaaatcagtcatgttatagaatattgaaacaatattttacaaggttttacaactcagcactattcacattttcaacgggatgaaaatgtggagatggagcggtggtgatggggtggggatggtgggtcgtggggaaggtggagcagggcattgtagaatgtatcccagcctccaacactagatgtcagtagcactcttgtcccagttgtgataaccgaacattttcaaatattgccaaatgactgggtggaggaggagcagggcgaatctcccctagttgagaaccatttatatagagcatataccaggacataagaaaagtctacataattttttaaagtattgaacatatatataagcagtacgttgtctgaacaaaataaaattcaattacaataagatatctagaaaatccccaaataattataaatttagcaatgctttcctaagtagcctgtgggtccaaaaagaaaaagcacaaaggaaattagaaaatagtgtgcactgagtattaaggaaagcacaagaaaaatatcacaggatgcagattaagcagtgcttagaaaattttcagcttcaaagcaaatattagggaaaacttgtaaaatcaatcaactaagcttccatgttaagaagctcaaaaactcagagcaaattgaatattaagtaattaaaaaacaatgcaatttaagaaggagccaaagtcagcgagctggcaaaagaacaaatagagaggaaaagtgggcaactcaacatcacagtgagtgatcagagagtcagggctggatcccagctcttccccaggctggaacgagtcatctcccttcatccacagattactgagcagctgaaggagacacaaaggtgtacgtgggaaggagtcaggcctcatggggatgtgtgcagttaaaaccctggggatgctgaaaggaaggaccatacagagcggtgtgagggccaagtcttccattacctgacactggaagccacgtggttaaaaccctggggatgctgaaaggaaggaccatacagagcggtgtgagggccaagtcttccattacctgacactggaagccatgtggttaaaaccctggggatgctgaaaggaaggaccatacagagcggtgtgagggccaagtcttccattacctgacactggaagccacgtggttaaaaccctggggatgctgaaaggaaggaccatacagagcggtgtgagggccaagtcttccattacctgacactggaagccacgtggttaaaaccctggggatgctgaaaggaaggaccatacagagcggtgtgagggccaagtcttccattacctgacactggaagccacgtggttaaaaccctggggatgctgaaaggaaggaccatacagagcggtgtgagggccaagtcttccattacctgacactggaagccacgtggacaatccagaagatgactcactttggcagccctgagagttaaaaaccagtttccttaggcaagacattaacctctctatgctgtaatttcaccctttgcaaaatggggaaatagcaatgcctcaacaacagggttactgtgaggatgaattaggatgacataggtgaggggcctggcgggggtggtgagcacaccacaaaggaatgcacactgctttggtcattgctgctgatgtctgaagcaggaaaaggtggtcagggccatccctcctgccccactcaaccttttctctcctccctcaccagggctctgataggctctttcagctcctgaccctctccctctaggatgcaggttcagcctgagcctgagtccacttttctgaggttgagcaacacaattagaatatgtggaaaatctgtaaacagacaccagcaaagagccagatgctccctggagccagtccaagaacaattaagcagccctttgaagactaactgagctgggggcagtcaagagcttgtcagctccaggcagcaagatctcaaccttcaggggcagggagcacaaacctctctcccttcctctctctctctgaaagctaaataacaaaatatcagcccctcccaaaggcacagtggtgagatgagggccaccaaaaggcctgcttggcaggacaccctgtcaggttttggggagagaagggcagaaccagtagcctgcaggtcacacttggcctttaaggtgatcattcatatcattacagttattattgctcacatggcattttaaaaatctgaattaattaccatcactgaaggatgttgcattttcacattcaaactcacatacccagattctctggaggaagccgtgtgtaaggccacaatgagcacacacgttccacaagccacagtgggctagagctgaggagctgcccctgggagagtgggtgcatcagaatttgccacagtaagttccacccctgtggtttccccatcctcacgctggcatttctgtcattgcctctttctcactttaaacacctgctggcctatttgtaaatttgagtttacaacctctgctttaaaacagcccacatttattagataaaggaaatgaggcctgggagggaaactgaggaaagaacttgctgaggccatcatccgagccgaaacaagtacaactgcacaagctagagaacgctgttgtaaaccaaaaataaaatagggccccctaatcatctgaatggacaccctcctaaaccagggctctttaaatttaatctgagagagctggatgcagtggttcatgcctgtaatcccagcactttgggaggacaaggcaagtggatcactgaaggtcaggagttcaagaccagcctggccaacatggtgaaaccctgtctctactaaaaatactaaaagcagccaggcgtggaggtgggcgcctgtaatcccaactacttgggaggctgaggcaagagaatcacttgaactagggaggctgaggttgcagggagctgagatcgtgccacggcactccagcctgggtgacaaaagagccagactctgtctcaaaaaaaaaaaaaaaaaaaaaaaaattaacctgagagactgtttcaggctatgacaggaaatgggggtcccacttgcctcattatacccctccagcgttaacatcaacacagacgttaagtctgataaggaacagtttgcagcctattctctctgaagcctgctagctaaaagcttcatcagcatgataaaactctggtctgtacaacctcttatcctaacccagacattcttttctgtttgatctcaggtctttagacaaactcaaccaattgtcaaccagaaaatgtttaaatttacctataaccaccccaccaccaccccgagttttcctgcctttctggaccaaacccaatgtattacaaaagtaattgcaatttttgccattaaaacaatctctcaggttaaattaaataaaaagtaatggtgaaaactgcaattacttttgcaccaacctaatatttcttaaatgtacttaattggtgtctcatgccttcctaaaatgtataaaaccaagctgcaccctgaccatcatgggtacatgttctcaggacctcctgagggctgtgtcacaggccatggtcactcatatttggctcagaatcaatctcttcaaaggttttacagagtttgactctttgcaccgacactgtccttctggtatcttatggcacaagaccagctccaatttcatattctgcctacagaaaccactctggctaacaccattctccctcttccctaaattccaaaccacctgccatttttgctatttatttggtaatgaatcacttactaccatttatattttggtcaccatttatcgatgtctgatatgcggtagatattgtgctaggtcccgggaaggataatgtgtgaattacgtgcaatcctgccattcaactgactgatccagtgcagtagaaaaagcacagccttggagccaaccaggaacgagtttgaattctgctctgatgcagaattctggctttgggaccttgggtaaggtattcaagagttctgagtcttggtttcctcatgtgtaaaatgaaggctgtgattcctcccccacgtggacgttgggaaggctgatgagggcacgcacgcaaaagcatggcgctgactgtggtctccttgctctcagatccatgacctccccttcacatcctcaagggcattgcagggcactgcatttcgcagacgccctggttcctggcttcccacatgaggccaacaggaagactggaaggcagcaggaagggagaagccagggtatttctcccctttactcttacttttggtagcctttctggccagaactgcgtctcctccacagtgccagatccgtggcagctgccatggttttagctgctgctaggaaaccctaatctccaggttcaacaaataccacctcttggttcttcctggtcaaggttgttgtgggtaagcagcatctatcggtgccagtggtgaggggttaaaagaatttaccaagataattgtaggtaaagaaagtcagatttattagacaaagtaggaaaatacgttgccaaggagcaatgggcagaatcagcagaagaggagctgactgccaggaaacaaagacttgctggagattttataggacggctcttgggttgattgataatgccacggcagcagggagctaacttgcattcttctgttcaccaaggagatgtttgatgataaaatgaagcatttgaggataaacagaaagtttgtgagttatgaacattatctgtgcaggagggctatacatcctgggccataaagaaaggcagacctgtagcttatttgctttatctctttgctttcccctggttctgccagcctgactcttttcctttaattaggactccacagagatagcaataccttcctgcgggggctgatctctctcctctttggcagctcagctaactgttatctatgcaataaattccttactctcaggagttaaattgtatcccccacgaaagtccatttattgaagccctaccccaccaggacctcagaatgtgaccttatttgggagtagctagttgcagatgtaactagtcaaaatgaggttaccctgaaatagggtgggtccctaatccaataaagactggtgtccttatggaaaggagaaacatggagacaggtagaacactgtgtgaagatgagggcagacatcagagtgatacctctgcaacccaaagaacaccaaagatggccagaaaaccttcaggagctggggagaggcctaggacagattccctgtcacagccccagaaggaactaaccctgctgataccttgatcttgaacttcaggcctccagaactgtgagagaatcaatttctgtttgttaagccattcatttgtggtgctttgttatgacagtcctaaaatacaaatacacctactttaaatcctttctgcttggtttctgttttctgatggaacctacctttcagttgtaacctgcatctggcacatggcatgcagtttgatgagaagggggaaacaaccctgatgctggtagcaacaggagactgacagattcctaggcagacagaggtgggttcccggtgaaacctgaccttcaagccaaggacggtttaaagcctgaaaactgagctgccacttccagatagagtccacaactagaatgagaacttccatcccagtcttacctactctctctattggtaccttctgaatgatgccttttaaccaattgaatggtgctttttctaagcccacccatggaccaatcagcatgcacttccccattctaagcccataaaaatcctggactcagactcacaggcgactgcctgcttttgggtcccctcttgatgctcagagctttctttctgtcactccgtaaaattctactctgccttactcactctccagtgttcatataccttattcctcttggtcacggtacaaaaacccggaagtcactgaactacgagagcaaaagagctgcagtgctgctgctcaccgagctgtgggcggtgggagtaaaatagctgtaacactccgtcccacttgt

SEQ ID NO: 1343 - DNA, 1938 bp, Homo sapiens
aaggttcatcagactttaactgataacacacaaccagggcgagaccatgtgtttattcatgagaagtgaatgcgtgtcctgatgctggatggggtcagctttccctgaggcacattgctgcacagaagacagagatcctcagaaacaggtttccattagcaaggaagaagtgggacttgacaaaaagagatcccatttcaaataaatattaagagagcactgatcccaagaacatcaaaagtccttctgggttctcccccgtctgatacctgtataaatgcttaccttacagttctagagccaaaatcagaaaccaaggtgttggcagcactatgttatggcagctcgaagggagaatctgttccttgtctcttccagtttctggcagctccaagcattcctgggcctttggctgcatcacttccatctctaccgtgttggtcacattgcctcttcctcctctatcaaatctcccttggcctcactctaaaaagattggatttagggcccactcagataatccaggatgatctcatcctaagattcttaactatatctgcaaatacccttttccaaacaagataacattcacaagttctggggattagagtgtggactttttttgttttttggcagagagtgagtgaccattcgaccattcactccactgtgccacagagatgtcataagacagtgtatttaaaactccagcaaaggactggcaccagtaggcatgtgataaatattggttgaagctaaatttatttatacgtctttgcagcctcagctggcactttactcactccctatgccattccttctggggattctggaaaaagacagcattctcttggcctgaacaaaaagaatgtgagccaacaggacaaagggtataactgtggggatgtagagtcctatgcaggaaagagcaggctgacccagatggcagagagaaagaacaagatgaccatcacagcaagagcttggaggaggggagagtagaacataagcaagaacacaggacatgcagaattgctggccactctgtctcattgcttttattattctggaatgggctgaaaataacttagaagcgccgggtcaagcagcaaccttgaaagtatgtaacttcttcctcttgaaaaatttataatttcataaagggtatactttatagaccctatatccaagcttatttttcttctgaaaaaacacatcaatctttccactccctcatttttcaaataatgagccaaagccattttctcattactctgttttctatttttcaaagaaaggtgatactgaaattccatactcaaatttcatgctcagagaattccccaacttgaatgaagtatcataggaatcatctatcctagccctgtctcttacagagaaggaatgtgaggctgagagattttaagttacttacccaaagtcacaatcagtgggttggaaggaaagaatgcactgcctgaagaaacagtttgagccaaatcccaggtggaaaaagttcctggaaacctacatagtcgagctggtctgagaatgtggaatggttgataaaggtgacaagctagtcaccttcctgggtcaccaactctagtcaaaaatgtctctattttatctcttaaattatccctaatattctgtatgcaatctcatttgccaagtaaaggttagacccttaaacccataaaagggtcattattcatattctggagactctgagaaagtgaagtgaatgcaaggtatgaaataataagatccataactttgtcatcgattgtattgaatgtactattcatcaccatccattgacatgcagtcaccaccctcataccagtccctataatactcaccttttcaagaatacatttttttcttcacttgggctaaaaaccaaacatctaaaatgacatgatgaatgaaaga

SEQ ID NO: 1344 - DNA, 3013 bp, Homo sapiens
attgtcacaggaaggcagtgcttgagctggaccaggtgcccagcggtctgatgtggagaaagagtgtgattttaagtgggggaagcaggtggggaccgagagttgacatccaggctaaggggctcaagcaagcagaggcttggtgcccgaatgcagagtgggttcacaggaaagagaagagaccaaggtgcccagggtgtgggtggttgaggagcctgaaaacatgccacaaagagcttgaaatgccacgccaaggacttcagatgtctcctgcaaccatcagagactctggcagggtcacagtgacccacccagaccagcagatgcccctgtttatccctggacttgggcctgtgctccaggagctgccatgcccaggaagagggatgcacgggggtctctcccaggtggaaacagagacctataaaaagccttgtctgctgacggacagtgttcctgggaagccctgcagcagaggtgccagtctttccaggtatggggctgacgctgagctctgaacatccctggggcctgcagaggcaactgcgctgccacaaagagaggcctgatgggcatcctcaggataataaaacgtgaacagctggggtctcgcggccacatgatggtgttcaagcccacacctgctccctccaggccctctcacccacccttggcacagaaggtcttggagagagagttgaaaggtgctggactgactgctgagaatttgttagacatgcccgtgaggatccggataaaaatacccaggtcttctattacaggagcaggcagcagtttacatggggctctcacgtgtatcagttcaccccattttcactcagagccaaaaacttatgggagggaggtgatgtcttccccattttacaagggagaaagcagactcaaagaatttgaccattaaagaaagtggtcaggtcttggccacaaggttttctgggtcttggaactagccctgagcggtgtgtgtacagatcacgtaatttcggcagcccagtttcctcatctgcaaaacggatgaggtgaggaagtcgccgggtcactgtgacgatgccaagcgtgcttcctgtgcagagcttcgggggcctgcagggacatccagcaccacagcactgtcattaacatcagtcaccacgtggctaaggccttggagctgccagggccacaggagaggcagtggagcacgtcgggcggtggaggaaacccacgtctgagcagggcgactttccaaaggatgctccatgggaacacccgttttaagggatttaatggactttacctttatatttatatttatgttattttattattttattttatcttttggcgacagattctcgctctttcacccaggctggagtgcagtggtgtgatcttggctcactgcaacctccacctcccaggttcaagcgactcttgagcatcggcctctggagtagctgggactataggcaagtaccactacgcccagctaattttttgtattttttaatagagatgtggttttgccatgttggcaaggctggtctcaaactcctgagctcaggcaattcacccacctcggcctcccaaagtgctaggattataggtgtgagccactgtgcctagctgactttacctttgtaaaaggttccatgctgtaaggaggctgggcccggttgggtgtgatgggattcacagatttctttactcaaggcctccagggttttctgtgtgctctcgtgagtcccctgcagggaggtggacgtgaccagggaagcccttcttccccctcacagagcgccaaaaggacctctcattccacagagaacactcaggggtggggttgctggagtgggggtcacagatgacccgggccctggacgtgggacgtgggctgcgggactacaggattacagaggggtctgagaaggtcttactgaggcatggggtggcctcaaggcagagctagagcccaacagggcagcccacgcagggtgggcagagaaacggctcctgtctttcagggaactagccactcctctgggacctgcagccacactgggtcccactctttcccgccgaatggaggagaggagaagcacaggtcctggtgcaggcggcactggcatcctgtgaggatgaaggcctgtccatcccatggctgtgcaggataaggaatgacgggctgtgggcccaggaagtgcttcccgggcgccggatggatgggcaccagggccaggtgggggctgcatgggtcccatgcccaacctcagacctcaggatctgaatctccactcagagaatctctgcccttaatccctttgggatcaattaatgttcccaagaaaaatggaaatttaatttccatagtaagttctgagaaaaaagtcacttccacccgggggaaatttcatggctctggtttgtttgctttgggccagggcttctgcaggacacagccagtgatcagacgccccgtggaggataccgccgagcagccagcttgcccggaaggaaaaagggaggcaattccgaagagcagacgagcctccgagacaacagccgtgagacgatggccggagctgagtgtcaacgcccaaggatttccagggcttcctcacccatgggttcctgaatcagaatatttcctgtgcaaagcgccatgccaggctctggtggggagaggtgagcatcggatataacccgcccgtggaacaggccatgatgaggatgtgcaacagcaggggagctccagggcccctgtcctctcccaggtgggggtgagagcccattctgcctggtgggcaaggaagaggagcgtggagaggtcttcctggccaggtctgaagtaggggagggcacagagagcccagggtgacccaacctggagcctcgttggttctcccagtctttctaggcccagaggggcaggctgtgagaggggagtggagggagaggctaaaagccagactctgggggcctggaatcaataaacagggagtccactgggctg

SEQ ID NO: 1345 - DNA, 2124 bp, Homo sapiens
cacacacacagggacccagatacatgcacagatgcaggtccacagatgcatatgccacacacaggcgtggctatatgcacacgcatcccatgaacccgacaggcacacggacgcagatacacgaacattagaacgtggacctccacagccacatgcagtgcatgtccagacacaagcatgagcacacagacacatacacctcgtgtgggacacagccggtggctctggagagctggcaggaagcctggagtggccctgagtttgcctgttatgtgtgcacagcttggtgcacccagcctcagcagccctttcagtgaggtttttatggttttgttttgttttttagagatagggtctcactgtgtcacccaggctggagagcattggcacaatcatagctcactgcagcctcaaattcctggactccagtgatcctcctgccttagcctcccaaggtgttgggattacaggcgtgagccactgtgcctggcctcaatgaagctttttgggcaggccttcggtcttttcccgtatccctgcttaaacattaaacatttccctgggcaatgatgccacctcctgtaccaactgactgtcccatcggctgcccaggtttgtggggacagggtgttcctcctgcaccctccaatgtgacatttccagcccctcccaccatgcccactggctgctgggccctctccaagcccaggctggagcaggctggcagctgatgtgtttatttgcctggcagcgggggcgggagggaaggcgtggaggtaattggtacattttgtaagcaatcatcccctggcaccctctgccgcagcgtgtgggccgccagatcccgttaatcatgacctggaggcctgggtccccccgccacctgacagcctcatttctctcctcggaaggatggagccgctctgcctccctaatggcgttatctgttattcccggacacactgctctctcctggcacactgatggagccagggactgtgcacggggcccagcgggtgggtgaagagggtggcaagcaggggaagacactgattctgcagcctgtgactggccagaacttggtcgagtgttaggggcttcttctgcacagcactgcacccatttcagcagcagagacagcgggagaggctggtgccccacaggaggccacgctacttgaggtaggtggcatttgataccaggtgcccctgactgtagcctcccgtggaattttggggctcactccaaaatgaaaactcagagcccattgttaaaaagttattaatcattccacgacggcaacagcagagcattaaaccaagcagcaggcctggagagctcgggccccatgtgaatgcacaggccacatggcatgcagctgccctgtccacgtgttctgacacaagcttatgagcgcacacacatccacctcacatgtgtgcacacatgcacaggcatgcccggctgcaggcaggcatgggggtcacagtggggtgacccagacccaggccttgctcatcaggggtcaccagccaaacccctccctacctcagtttcctcactgcttacaggggcccaggacacagcccaatgcggtggccaagatggtgcccagttgagggaactggctggtgccccctggctggcctcccacagggaaacgtgcctggcatcatgattgatgttgctcttaatgacggaaatgacggccgtgtatgagagacgcaggagcaaatcatccctgcatgattaataaagggcccaggggatgccggtgtgattaattcctgcacttactctacctcacctgctcatacatgctcacacacatgcacacagcacccactgggtgccagggctttgcaggggctggccctacccatgtagcactccagctggacccaatccaatccttcattctaagcatccatccatccacccatccatccatccatccatccatccatccatccatccatccatccatccaatctatccatccaccaattcatctgttcatccatccacccattcaccagtttattcatccagataaatcaatttatccatccatctgtctgtccatccattcatccacccctccaacctcattcatccatccat

SEQ ID NO: 1346 - DNA, 2019 bp, Homo sapiens
aaaaatcactgtggatgactgctgtgtacaccagactgccccccaggcaacgaggtccccacccaccattgcctgtcctctgggtgctggtccactggcaaacccattcctggaggtcctgagggggctgtgccccatccccatcccctcctccggccctggcctctctttcccaatgtctaatccttaaacacctgggaggggcttatgcctggggcagggttggtctgagttatgcagttgctttgccgtcagcacccggaggcccccggcctctaagcaaggaccccactgtgtgtcaccccccatcctctcaggaagccgactccatgcccaggagatgcaaactgggttttgaccccatccccccgcccttcctcaagctgttagctcggaggccttggagcctgtggccatggctcagggcacattctcctccccccagctgtgtccacacactcagcagcccccagagcagccccccatcttcaagccagaaccagccatcagcacagcccactgtgagatgaaaggtgctctgtcgacgggtgttaatgtgctcctgttccctcctcatccgttcagcaagtgtccaccgaccgcctactgtgtgggggcccacggccaggcctgctttgggtgaagcctgtgtaatgttttgcagacgggagccctttccaggggagagtggatccctcatctcccaccctgtctgtcctgagcacccttagaccaggccatggtgcacagtaggggccctgggaatggcgctttcattggctaggatggtgaggaagccttcttaactctccaagatgttgtcatggagacccctctctcactgccaccctcctttcggtctccagggaacagggtcccctgaagaaggtcagcagctctgcaggggctcgggatctctgtatcgctggggggactcccctcgccttctggggactctgaacgatgagaagagccaccaaacccaggtgtggggacttggagaggctcggctcccctgggtgctctgtcccccagggatgtggcagattctctgcggcagggtgccttgcaggacagagggacagagcaccctggggggccaagcctctcaactctcttggggtcaaaccacttcacaaagggtacctgaaggttaagaagttctgggatttgggagcagctagctgggcctcccagagccacagatggtggcccagtaaaggcagcctgaccacagcctgaggtgacagcatcttgtggccaaacgctcagccctgaagcagcttctgagggtggctgggctgactgagaatgatctggggcttgaggcctgggtgctcacagccttgtactgaaaaggagaaaaacaccagtcctctgactttctgctgtacccaggggctggcccgggatcctcagcatctctgcatggtgctgaagtgtgtggccggtgtgagtgtgtgtgcacatcccacgcaggtgagcgtcactgtgaccctgtggcttggacacctcacttgtttgtgaggctccctctgggcctcagtctccctaccggcagaggaaggggcaggcagcatggattaactgcgcccaagcccttctgacattccaggagcccctgttgtgccaagggccagcctggacacttctggctccctccaaatgtcagcaagggagggagtgagggctctctggaacggagtgtcttaccgtgacttattggatcacgaacagtttaataaggagagggatgggggagggcacgctgctgcccgcctgctcacctcataaattaggcatcagatgttcacaaaggtatctttgagtaaacagaatcatcttgttggaggaagggctgtgtctgcgggccaggcagtgagtccctggggatggcgcagtcaagatggcgaagacaaggccgctgcatttgtctagcgtgcccttcgccaagcccggggatggctacgggtggtctcgcaacaaccttggggcagctgggggctgcttggcagggag

SEQ ID NO: 1347 - DNA, 2494 bp, Homo sapiens
ggcacctgaccacacgcacatcctgctgatcagaacagcaaaggaagaaggcgccctggcccaggggctccctcctcagggtcccgtgtcctggcccaggggctccctcctcaggctcccgtgtcctggcccaggggctccctcctcagggtcccgtgtcctggcccaggggctccctcctcagggtcccgtgtcctggcccaggggctccctcctcagggtcccgtgtcctggcccaggggctccctcctcaggctcccgtgtcctggcccaggggctccctcctcaggctcccgtgtcctggcccaggggctccctcctcaggctcccgtgtcctggcccaggggctccctcctcaggctcccgtgtcctggcccaggggctccctcctcaggctcccgtgtcctggcccaggggctccctcctcagggtcccgtgtcctggcccaggggctcactcctcaggctcccgtgtcctggcccaggggctccctcctcaggctcccgtgtcctggcccaggggctccctcctcagggtcccgtgtcctggcccaggggctccctcctcagggtcccgtgtcctggcccaggggctccctcctcagggtcctgtgtcctggcccagatctgccctgcctgccagcaagggctggggtctaagatctccaggaaaaagtccctctccctttgtccggaaaaagtcccagaggatcagcggtgtccctcagggacatcccagcctcggtgtggatgcgggctagctcaggccctggcaagactggcttctcctccctcttccctaccccaaaccaccaaggccgaggctgcaggaggggtctggccctcggccacacctggagaaggtggaaggtatgcaggctcggggggatgccagctcagccctgctgccatgggcactgccaaggactccactcacaaagccgaaaggcctgcctgcctcaaacaaacagagaaataaataaataaccacagcacactttgaaacaacttccaaattaagagttgcatccatgctgtcaagcccctgctagcagcttctgtggcaccttccgtgcaaaaccgtatctcagcccatttattagaatgatgaaggcaaaagggatctaaaaattgcactccttccttaatgagcagccgaagggatcggtaagcataatttcagaggccagtaatattttatataatcgccgagtggtttaaattgaaaacccccaactgaatcaatatttactgcattgaaacgaaatgaatagtaataagtcactaagctccctgtcctgtttcataaaataaaaaattataaaaatgagcacaggcacagggaggccatcacattaacttttacagcacttggggagccgtaaccgcctgttcccataaaataaaactctaaaaaacctgccggagtcctgcctcagcagcacgtggggaagcctggggagtgggaggggaaggggagcgctgagggccatccccacaggcctccccagggccaggatgggccccaagaccccacaggctgaccacgcctggtgcccacccacaccccacacagaggcccagagcgccctggacccagcttcaacagagacttcctgccaccctcaggccgaacttcctgctttgatttctttaccagttttctcaaatgacagagtatctcagagagcgtgagtgagcagctcaggctacgggaccggtggcagcccgccagccctccctctgagcaggccccaggctctgggtgggaaaagcacaaatgcctgccagcgtggaggatggggctccggcagatgacccccgaggggtgagcacaggacctcaccccacagtgcaggagcctgtggccacccctgccaacaggcccacacaaggcccgggcaggtcagggcctcagagcacagcggcgccggcagaacccagagcgagggccagccgggaaggagggccggccgggacaggagggaagcggcaggtcgggggaggggggtgctgtgggcagacacacgaggggatgggagcacaggaacacagcccccagagggccaggagcccccacactcaccctgagaccctgggcaggaacaaaggcctcattccaccaggtaaggctggctcagcaaggtggggaagggggcctcctgcagtcaagaatgaggagccagaataccggccaccaacgggcaaacggcctgagcagacctttcacacgggaagaccaccagtggccttacgttagcccgagcaggtactcaacatcactggacaccagggaaacgcaaatgaaaaccacagtgagaggccacacacgtgagaatgcagattagaaaggcggtaacaccacgtctgaggggaacagaaagggtcgcggcacgctggaaagcagtttggtgatgtcacatcaagtcagcagatgtcttacgtcccagcgatcccacgcgcgacagtcatggaaacacaggtgcacagaaaga

SEQ ID NO: 1348 - DNA, 7820 bp, Homo sapiens
gttcctttttttttttttttttgctatagcaaagaaaaattcttagtggttgttctcatatgtctctcttacacttttgtaggtcctatatattagtaggcttaattcctccccgttacttgtggaccaaaaggtaaatgccttttacattttgatagatattaccaaattattcattcctgaggactacacttgccagctcttttaaactgtgtgcaaggctgatgggttaaaaatggtatctcattattttttctttttgtatttcaaacgtctttaatcagaagtaaattttagcatctttgcttctttttttgtcatttttcttttttttttttttttgagctgtttgtatcctttgcccattctcccataggggttttttttgtgtatgtcacctaatttgatttgtaaattaaggaatttggaaagtagttctttgtcaaatatgcatatatttttcctcaatatatcatttatcttttggcttttggcgaaaaggggtattttttttgtcatgtacttttacgttgtcgaatgtatttgtctttgcctttgtggcgtctgagatttatgtcatgcttggaaaggcctttgtgtcagtgttataaataaattcacccatgttgtctttcatttttttgtttttttttttttggtgataagtctttttaaaatactggcataggaatagagtggcattaaatggaaagtaataagatcctccatacattccttggtgctttataagaaattggttgacatgtgacacctttgaaaattcaaaggagctgtgtttgccattggtgggccacggtattttatgtgaccctctaatgttacatataagggcagttattgcctttttgcctcttttactaactcagtgagggtggggagctgaatggaagagcaggggcttgagttactggtttctgttcacccttctcagcctcagccgtgaatgtgacatgatggtcgcttgctcttcctgtttttgtcgagtggctttttgttcttaagcccctttgggtaaaatgcgttaacctggattggggggtgtctctcccttgtgtgttgttgcagagcagcctcttgctgtcctgatgcatgggcgcagtgatggattctgtagcttttttgagtgggatcttgcgaagatgtcaagcagcattacttaccaagcctgtcgtcatatggtctcgcatcagaccttaattttcttttcagcgcatccatgcctgcttatttccagagcccccgctttggctttggacttcaggtctgtgggaggagtgtcccaggatggctcgtgcggtcatttccaggcagtgccgctctccctgtggcttgtacccacagtgcctcactgtgtgagtgtcctcctgctctggttgcccagccggccatcactccacagcgtgtgttcatttctcccaaagctgctcgccttcagctgtgctcacctttgcagtgtggcttccatgtctgccgtcctctggtgctttcagacttggcttcgtcactgcttggtcagtcctggagggcccctcacagtttgctgttgctttcagggcgccggtctcaatgctgctttgaattctgttgaacttgggctgaaccctgtgtcttcttggcagcatctgctctctgtgactttcaccttcaaacaccaaaaggaccggtttacttgagccctagatctgtggtttctaattaattgaggctttcgcatgtaaagatagctttttatttaaagcaagtagagtgagccagggtccggggctctgaggaggaaagggggatcaaagctgtgaatatggagggcatgatacacggtggccgcggggcccacctggaacattcttctcctcataacccttctgctagtgattctggtctagaaaagagggagattttgctctacaaagagggtgcttcactaaactcctacagctgaaattgcttggtcacagcgaatatgcagatgtaatcttgatggatattactaaaatgccctcatttgcccttctctattctgggcagcaatagggaggatgtttgcccacccccaccccccaccccatctccatccctttccttgacactgtcctagggcaggaatgtaacacaggtccagctcgctagggataaggggttgttgtatagggacctagatacgcacacttcagaagggtcctgggaaagtcagctgcttggatccttggtttcctcatctttaaaatgggagtcattgtacctgccttaaggggcaggttgggaggattcagagacatactgcgtcctaagccttacttacgacatgcctggcatgtattacacattcaataaaagctggtcacggatgatgacggtggtggagtgactctgccaagtagagggggaggctgaggggtgtggcagcaggggcagtcatcccctttcacagcagcccaggctggtgtgggggcggctgggtgcctggaagtaggagaatgtcggtcctgcccacatcagaggtggtccttcccagaagctacctgggagaccagtggtggccttgtgtggtcacggcagaggctgtgtgtgaggtgaaagctattccacaggtgtgaaattattctctttctttgtaagaaagtaagattttggaagtaagaaattaaagaaattgaaagagcagaaagattgtctttccattgattgagtgaacagaagagacctgtgaagaagttgaggaggtgacaattttgaacttaccaaaaaaccatttcaacaaagttctatccatgtgtattttttaaaagaagtatctcacattctttttccagagtatagtttttataaacaaaaacagaatttttgttaaaatacgtatcgatactgaaaataaatccagcttgtatgtgcttgttttttaaattaaaataatagcagtgtaaatgtctaatttgggtgtggtttttttgcctagaataatgtgacagaaacacctatgattaatctcctgaattaaagagttctggttctgatggttttagtgagtggaataatcaaattcatttttgttttctgaggcagctgcaaacttaatctaaatgaaaaactaatataaatcactactctgcattatcaaaaatgaattccattcccatctctctctgagtggggaggaatctgcattaagcctctatcaaactgcaagactgggacttgtattcatctttgaattccctttggttttctgtatgtaagagattgatattgagtgaatatttcctataaatgtaggaaaaataatttaaattcccagtcagtgtgccatttagtgattgcaattaaatctaatacttgcagcgcatgacaaaaggctaatttccttaatttgcgaagagctctgacaaatcaataaaaaaggcaaataagggcaaaggatatgagtaggcagttcaaagacaaacttagacaaattgccattaaacatgagaaaagatatcaacctcatttataattaaacaaatgcagccgggcgcagtggctcacgcctgtaatcccagcactttgggaggccgaggtgggtggatcatctgaggtcaggagttcaagaacagcctggccaacatggtgaaaccccgtctctactaaaaatacaaaaattagccaagcgtggtggcttgcacctgtggcctgagttactagggaggctgaggcaagagaatcacttgagcctgggaggcggaggttgccttgagtggaggttgcaccactgcactccagcctgggccacagagtgagactctgtctcaaaaaaaaaaaagcagcacatcaaaacaatgaggtacatctttcacctatcagtttggctgaaaaagtgaaagggttcgatacccattgctggccactatggggaaggaggcccttccctgtgaacagataattgctgctacctcttagagggtaatttggcattatcaactgaaatgaaaaatttaccacaattctgctagaagttgaggctacagatttacttacataagaaagccaagatgtaagtgaggggggtgtgtgtgtgtgtgtgtgtgtgtgtgtgtgtggagtgggggtgacattctgtgtttgtaatggctttcttagtatcaactgggaactggttaagtacgttgtgatatagccatccatggaatactatgaagttagaaaaaaataggtcagcgtgtatgtgctgctatggaaagattttttttctttttttttttttttgagatggagtctcgctctgtcgccaggctggagtgcagtggcgcgatctcggctcactgcaacctccccctcccaggttcaagcaattctccttcctcagcctcccgagtagctggaattacaggcgcgtgccaccacacccagctaatttttgtatttttagtaatcttgatctcttgaccatgtgatctgcccacctcggcctcccaaagtgctgagattacaggcggaaagattttaagctatattaaatagatttctttaaagtagggtacagaacagtttatgctgatagatgttgaaaattttctctgaaagaataccccaaaactcctaccagtgattatctttgggaagaggggctgggggaaagttttattatttctgttctgtgatctgaagttctaccatatgcatatattgtattttaaagataaaattaattaaaaattggccaggtgcagtggctcatgtctgtaattccaggactttgggatgctgaggtgggaggatcccttgaggccaagaattcgagaccagcctgggcaacatagtgagaccctgtctctacaaatttttttttttttttgaaatggagattcgctcttgttgcccaggctggagtacaatggcacgatctcggctcactgcaacttccgcctcccgggttcaagcgatactcagcctcccgagtagctgggattacagacgcctgctaccatgcccgcctaatttttttttgtattttcagtagagacggggttttgccatgttggccaggctggtctcgacctcccaacctgaggtgctccacccgcctcggcctcccaaagtgctgggattacaggcgtgagccaccgcgcccggcctacaaaaaacttttttaaaagctgggcacggtggtgcgtgcctatagtctatagggagctatagctatagggaggatagcttgggcctaggaggttgaggctgcagtgagccaagattttgccactctactccagcctgggtgacagagtgagatcctgtctctaagaaaatgtaattcaaaattgatctaacttaggtgtaggcccactgacattccacacaggggagaaaatcaagagcttcaagaaaccagtgagtagcccatgttgtaaagctgctagtacagagggatagaggatcatatttgaacttgaattgtgcctacgtaagaggctctgacctcctctatcctgggatcactggacctgataaatctacacatggagtgtagaacttgtgatcgatgatgagtttctcttcctttagtctggtcatatggctcagactgaaattaactgtaagttcactatgtgccagtcatttagaagcttcttgttcaagagtgtggcttgttagcagctctaggggggaatctttgaatctcattgtcactgtggaaaggaagtgttaatgtaagggagaggagagcaaagcacttcctttctcatattgcagaaaaatggaatcccactcttaggtgttaatcatggcgttccgtttttctcagtgattatctttcaagtgtagttctccacctttcttctgagaagtagttaaggaaaaaacaggagggggaagcctcattgggaagccgctttcagttgtacattctatttcagaaatgctctgttgcattcctttctgtactggtttttgccctgcagtccacacctttaaaaagcctgaacccaccttccttttgtccttgcattccaaaagtcactatttacgcaccccgtgtcatgagaatgctatgatgagtaggtaacatttgcctatttgttaggtgccagctgagttgcatttttataagttttgccaatttgagaaagaagtattttgtctcatgtttatgcatttatttatttttgagacaatgtctcactctatcacccaggctggagggtagtggcacaatctcagctcattgtaaccttgacctccaggactcaagccatgctcccacctcagccccccgagtacctgggactacaggcgcccaccatcttgcctgactaatttttgtatttttagtagagacagggtttcaccacgttggccaggctggtctcgaactcctgagctcaaacgatacgcctaactcggcctcccaaagtgctgggattacaggcatgaaccaccgttcctggcctcatattgatgtttgtttactgatgaagttgttaagcattttttttcttttctttttttgagacggagtcttgctctgtcgcccaggctggagtgcaatggtgcgatctcggctcactgcaacctccgcctcccgggttcaagcgattctcctgcctcggcctcccgagtagctggaattacaggctcccgccaccacgcccagctaatttttgtatttttagtagagacagggttgcaccaggtcgatcaggctgttctggaactcctgaccgcaggtgatttcacccgcctcagcctcccaaagtgctgagattacaggtgtgagccactgtgcctggcctaagcattttttctctacatgtaaaggctatttttatttctttttaaaagcctctgttcatacatagtcgcgtttttcagttgttacatttggcttttattgatttgtgagagactctgctgtgtatgttctttttttttttttttttttttttttgagacagagtcttgctgtctcctaggctggagtgcagtggtgcgatcttggctcactgcaagctccgtcctccaggttcacgccagtctcctgcctcagcctcccgagtagctgggactacaggcgcccgccaccatgcccggctaatttttttttttttttgtatttttagtagagatggggtttcaccgtgttcgccaggatggtctcaatctcctgacctggtgatctgcccgccccggcctcccaaagtgctgggattacaggcgtgagccaccacgcccggcctctgctatgtatgttctaggtatttttattgttttctacctcggtgttttgttttgttttgttttttgctgaaaagtattttttagatatataaaagttgtatttcttctgtagttactacgtttgttctggtatctttgtgtgcttagaaaaacctctagaggttattttggggtatgctgtgaagaaggatctaaatttattattaattcaaattctctaagcagcatctatttcagtaattctcccctttttacttacttgaaatggcccgtgaggccatctcagtctgatttctaccttgacaatctcaagtggcttctgtcctgccccttgcgccttgttccagctgtgcacacacttccagcacgtccttcctccccaaccctttgtacgtgtgattccttctgtctggacagtttccctgcagcaccccgatgcccacatgtatctgactaacctttacttgtcctttagttcttatttaaaatagcagttgttcacataggcttctctgaccactcccccatcgtgaaagatctcatagcttttatcatggtttatgatgagagaattaaaactgatggatccc

SEQ ID NO: 1349 - DNA, 1933 bp, Homo sapiens
tagcatatccatcacttcaaacattcatcatttctttgtgttgggaacattcaataccctccttctagctatttgaaactatacactatgttattattaactattgtcatcctgcagatgaataaaacactagaacttattcctcctatctagctgtaattttgtatcctttaacaaatctctccctatctccgccttccccctacccttcccagcctctagtattctctgttctatgtacacatcctttgaactagcctttctacttctggacataaatgttttaaccgggtgtcaactcatgctgtaccaaaaagctatccaaattctgagtatttctaaatttcaggagagatagtaatgaaggggtttcataacaaccacaggacctacaaattatatgtactataactttgccttcactagtaagtagatagagattgagattgtatttgctcataactccaaatcttttggtgggactagattgggagggttgcagaagtggctgctatgttttatagaattcaacagtaaggattactgaatgatgggtcaagctatattagaagaggaagagtctgggcctaagaaaggaacatatgagttctaatgtttcctctaccaacaattctgtcctcttgaacaagacaacactactcatccgtgaatgatgaaagtgagcgagctataaatttgcttcatgtttaatgatccatctgtactacagctaaactgagctaaacccacacaaaaggaaaaaggaattaacacttaagaagtgagttcttactaattgtctgccattgtagttctccaatacgtctcttaaccctgccaacaactccacaaggtaagtattattctctttttacaggctaggaaactgacattcagagaagttgctgtcctggtttcaaagccaacaagttacagagcaaggaatcaaacctaaatggttctgcctacaaaaatgggctccttgctctttgttgtattttctctacacccagtaacctatacaaaaaaaaaaaaaaaaaagtctctatcacagattttgtcacaatagaaacacatctaaatacaaagaagagagatatatttttaaaggaaaataaggagaaaaaaacaaagataaattcattgaccaaaggattaaatagttcacatttaaaaaaacaaaacaaaactctgaatcaccaaaagtgacttaaaatctgtgtttctacatagtgctaaaataaccagacgatgtgcggttaattaactctgtttagactaaggtaaatttgggtgtttggttcttttttcctaccagttgtgttataaggacatacagtgaatcactcctacatagtccaggaatagttttcaactgaaaggtcatttgtattgttaactcatacgaaaaacaaaagtaacacattcatcctgcacataactccagaactctaagttctcaatgaccctttctttaattcagtagtcatttataatttttaaaggtggggttggagctgggggtggtggagtccttactgaatttacttaaagttagtggctgaaggactaaattaaaattacatttaatccgaatttactcctagtgtggacgattccctccctgagctcaggagaattatctgtgatgtgatccagtcttctaaacaaggctggagagagaggagaggggagaggtagaaatgaagggggcggagaacagcttataaactaaaggaggttggccagacatggtggctcaagcctgtaatcccagcactttgggaggccaaggcaggtggattgcttgaaccctggagctcaagaccagcctgggcaacatggcaaaattccgtctctactaaaaatacagaaattaaccaggcacagtggcaggcgcctgtaatcccagctactcgggaggctgaggcag

SEQ ID NO: 1350 - DNA, 6301 bp, Homo sapiens
aaatattagaataagccccttttccaaaccataataaagttctgtcttcgggatggcagtaccataaagaggagccagtttcattgtcaatgtgtctctccttctaagaaggctttacttttagagaataaacacaaggcaagaaaattttcttccttaaatccctgtagtttctgacacccctaccctcagtagccacatatatactatcccttttctcccaaccccactttaatgacagtgttgtctttaatttgcaagctaaacttaattcagcacctatatacatcctaattaaggcaggaaatgtaattctgtccttacaactattgggctcagaaactgatttgatagcttaaactataacaacaagggtgtctgggagaatgaaccaagtcactgccttcacctcagccctgatgaatatgcctcatttttatttctggtttacttcctcagtttctgcatataactacaggttcattccaggactaatcctttgctctggatctcagatgtctgacatctacattgctcttgccagtcacatcttcctgaggggtactctttttaggtctagccactctgtggaatgctgccagtcagctgacaccaactatcactgctacttgaaggtaccaaatgcccattctattgacccatttgaaattacaggggaaaacaaagctggcctgacacaagcctttgaacaataataagctcccctcctcagggcctaggccaacaggtaattcagctctcttttcacatgtccacttctataattctaccttattctcttttcccactattccagtgttataatccaactcaacttcaattggcgtacatattttaagcaagaggttgtggtaagatgctgcttcagagactgagcagagatcaactataagatagtagacctaccaagaacattgtcaccataaacctgtagagatgtttaattcaaactatcccaagcctatgaaataacagcaattacatttatcctcccacctgggatacttaaaggttttacttgctgctttaaaaaaatgagttattccaataaaaagtgtttagtaagttcaaaggatcaatctcattataaagaaaatgtcaagccaatttgttaatccttttaaactaaaagtcaaagattattttataatgagttctttattgaagcaaaattcatctctttatattttctatggtctgcaaatttccttcaatatttattttattcttctgaacaaagaacttataacacatttccccccaatgacaaatcattacatttaggaaaaggaagtgttgtctttcaattttactattgattgtttctctctccactttaaatatatgagcatattagcagaattaggtaaaaaacatcctcaatttaatcctatgaaataataatttgatttaactcatatatttggaggatctttattttctctttattttaaactaaaaggaattgtttctaataagtatgaagtgatagcaggagaattccaaatgtcaaatctatttggtctttattatgtgaatagatttttccaatgcttacattaaacttaatttaataacattttctgcttccacttatagcatttttctatacttcaggtaaatcaattttatttaatcagccaagatctaagctgtcatttcaaaggcaaaattttcacaaccaaatatctctttctctagcatggaagtatttctttcccaaagatttgctgtttctgtttgacaattctaagcattaagagtgttcagatttatgtcacccagcagacttctacagggagagcctgagttttcttttttaagacaaaaactgaagtacaaagaagattaaccactaaggaaaatgagagctttttaaatagcagaactgttggctgaaacactttgggtagaagtgtttgggtaaaaaataacattttcccaagatgctgtgatattttgtgctaatatttcacacctaaggtgttgttttcttcatgcagaggcagcaatcggttggaaaatagacaaaacacaaactaacacacttttttttttttactcttaagacttaagctaatttgctacatagtgattaatgctttaatcaggattcttgggtttgaaaattaatcatttcatcaacagaatgtagaatttatatggatggaaaaatgctataaatcacaagaagaagcactggaacgtttagacattctgaaattattaatttttcaaagaagcctctgtccacctttcctttggagtcttctctgctaaagctccaatccattaattagtagctacattgctctgagtaaattatttgacttctctagcctttttgtctttataccttaaaatgcaatattaaaattcataaagtgactcctcctcttgttagcaggagcagcacagtcctttgcaaagggtcatgaacacagggaggcttattcattaagagccattattatagcagtatgccatatagccccaaagaatccagaatgcagtgctaggttgggaaaaagttccaccagaaagcagaagaaggtaatggaaagggtggggaggcaatacatatatatgttctaatctcctctatatgaatagaattcccagagcagggagataagtcaaataggttgaattgaaagtcaagagtgagaatagagcttgaggccgatatactaccagaatttctggaaagaaacttcctcatggagcatccacacagagatatctcacaatagggcagctgcaacaaagttaatccagcagggcagcacaagtgtattttgccagaacatcttgatttcctatataatcttgaagctgtccactgggttatatgtgccctagagaaggatacaagtaattaagatagctgatattgctttgtagtgaaaatatccatggagagttgatgaagtgtttgtgtgtttcgggaggaaatggggtgcatcaaggacctttaaccaaagatcagaaaacttcaggctgagttacacacagcgtcagcaagacaaaaatgggctcccattcaatggattgttatgactctcctaagaagtgccagctctgggtaaactaccagcagggctgcaagaatccaaatgaatcttcaagaacctcatgagcaggtcccaagccctcttctttccaactactactgagcacataatgtccctggcttgcccctacaaataggccaccagaagagactgagaaagagagagaagatccaaagtacttcacattttccccagagactgggttcctaaataaactatttaaatgttggggttaaactgagataactttcccaaagagacataaatttagtttcctcctgactccttcccattttctagtaatatggaagttttataaagaagggcaaatcagttttaagaaaattaaatacatatttttgcacttctaaatgtaatatcaaaaattaagttgcccctattattatagttctcttccagtgtggttataacaattaaatgaaattaattaacaagtaaatgaaacctgtggtgtgtagcatagcatctgtgagttacatgtcattcaattcatggtagcttctgtaattataagatgtctagaaaggtaggctgtcaggtcaggcggggtggctcacacttgtaatcctagcactttgccagtccaaggtgggcagatcacttgaggtcaggagttcgagaccagcctggccaacatggtgaaaccccatttctattaaaaatacaaaaattagccaggcatggtggcgcatgcctgtagtcccggctactcaggatgctgaggcaggagaatcgcttgaactcaggaggcggaggttgcagtgagccgagatggtgccactatactccagcctggatgacggagccagaaaggtaggctgtaagacccctttgtttagacttccttgtactttgtaaggagctcatctctccgacctgactgttacatatttgcaatgtgactgcccatgtgccatgcctcatgcttatagtcctgcctatggaccacatcatgcaatggcaccgtgctggtacaggaagaagttatatgtaggaaccttgataaaagagcctggtggctattaaatggattactaaaagttgtttttaaatatgtttttcatgttgaactatgagggtgatatgaatggacgtataacaaaattggtaaactctcagaaattctcagggccctaaagaagatcaccctacatcaccaccatctcaagcatatcttccgcgagacacagaagaaacttgagaagccacaatgagcacatatactgagcactgatactgatgcacttggcatgcatcacagacaactgtaatttttggtagactgattgatgtgacagtgttcatgttaaacaatgcagttatacttcacattagtcccagtaggcaggtatgacccatcagtattctctacggcaaaaataaaatgtacctctaacctgtctcacaactgcttcctgattcttccgtgttccaccatgattcacgagggaatgctggtggacccaccaccttgagggtccatgggtgcataagagatgactgtaatgcatctctggggaatgatgtgggaggcttattaggcaaacccattgtgtaaatgtactgacaataattgtttttatattgcaatataaagagtataacagaacataacagattttgtatccttggtttgttttggaaactgaaaaactgctgcttgattttgttattttaagtatgctttttggaagaataatttaaaagtagaaagggtttagactgtaaaaatgattgctttcttcctgtagtctgcttcctacaacactcaaagaatctgcaagaagagtcactgtggccacaacaaagcaggaaagcccccttaagcagattataaatacttttcataattaagttattctgaaaagaagcaccatactatcttacccctgtttactggagctcagtaaccacatgaatctggcccggtggctgcaaatgtggcatgcaaaacctcccactaaagttttaaagtacgccctatgtgctaatagtcctatgattattaagttgggttttcaaatacctgaacccaggaagaagctgtcttgggaagagagaatcaagtacctaatttatgcaaaggacatcttcccttctaaattaattaattaattaattaatgtgacgtatattttgtagcagatctactggggctaatgtaaccctgattagtttgagccaatcaatgcatggcatttccctgacaactgttatgggtctaggaatgggcaaaacatttaagtagtttcagtcaagctaaatagaaggatttgcttggagaagagaacttgctagaaatgcaaattttcaggtcctgcttcagacctactatgatgggtagttttatgtgtcaacttgactaggccatggtacccagacatttggtcaaactccagtctagatattgctgtgaaggtatttttttaatgattaacatttaaacagaagactttgatgaaaacagattgccctccataatgtaggtgggcctgacccaatcagttgatggccttaagagaaaaacactgagctcccccaaggaagaaaaagttatgcctccaaactgccatcggacttcagctgaaatatcagctcttccatggacttccagcatgccagtcttccctacacacttcagacttgctagcttccacaatcttatgagcaaattccttaaaatgagtctttctctatatatttacatatatacggtatctatcatgcacacatacatcatatttgctctgtttctctagggaaacaactaataacactgttactaaattggaaactctggaggtggggcccagaaatcagtgttttaacaaaccaagccttctaggaaattcagatacacctaaagtttgaggtctactatattacttcatctttattgcatctcattgacaattcagtgggagaagtttgaaattataccttggtacatttgctagtatcaatgtagctatgatgaaattgtttcccagaattccctgcatagattcagattagtgtaggccacagaggccattttcatgtaatttggagggtggaaggggaacagcagaatcctgtttcacatgcttttaagtttagaacagggcacgaggtattgttgcagcttacccacgttgtggcctatctgttggaccacctgcttggcctgagcaatagccaggctc

SEQ ID NO: 1351 - DNA, 2306 bp, Homo sapiens
ccatggttgtcaaaacactctgtaagactaaacaagtgaaagggattacaagtaaggaggcaaatgagtttcttaaaggtgcaccagcccagaaattagaaggtggagcatcaagatgtaattccaccactgcctggctgttgcacttggctatgtcacttgacatccggggtgtctcacttgttaaatggtgacccaaactctctccttggctgcctcacaactttgtgttaagaagcaaatagctagttgtggaatgaggagtaccaggaggagtaacatatgaggtatggcgctatcattttctgttcagactaactccataagagccacacttcttgtccacatccaagcttcctccactttgccaagtgtcattttaggctgcttcacattatgtttattcttcaacacatgcattagaagacctatcaattaaaaggcagagtgagaatgtctgttgtttagtttttaaaaagaaaaagactatgaaaactgcaaatgtgagtacaggttgagcatccctaatctgaaaatccaaaattgaaatgctccaaaatctgaaactttttgagcacccacatgacactcaaaaaaaaaaaaaaatgctcactagagtattttggatctttggattagggatgcccaccctgtgctatcatgaaaacacttctcaattatttcttatatttcacctccatttcctcttttatataactttaacctcttcctctctttgactccttcccgactcagaaatatacacaaatctcattcatttctatttaaagtaaaactagcaagaaagataactccctcaatcttgctttctctcctaacacacccttctcccactccttctattcacaggcaagagcttcagaaaacaaatgatgctcactctccctacttccccacctcccactgacctttagccatgctgcctgactcctgcctcaacttccctaaaaccttatgagctaaaggtctccaatgacctaactatgaaatgcaaaggatacttttccacctgtatccatgaagacctctttgccacacctggctctgctgactgcattccagaactcacccttcccccaagtcccttgcctgtcctgtggccaccaacttgtagtcttcctctctcacacatctatgtagctcttgtttgaacggtcactgtctcagccatgcttcaatgttctgtgttcccaaaaggttccttcctccattctcttctcttttgttatggctctctgggaaatacaggtgtggttcatcacttcaacaactacgtgcatgctaaagacttccagtctacagatgcagcttgttgctgcctgtgcgtgtcatgcccttatttattaatgctttcagtaatttttatttattttattagagctttcaaactcagcattataaatgttgatacagtagttacttaggaaactatcgaatgagttagaggataactatgaaggaagagcacttctttttgaagaaaacacaaaattccatgagcaggaattttacacacacagtaaaaaaaaggatatggaaaacaaatgccttaagatccttagaagttattttcactttatctccattctgtaaccttttctatatattgcgagggtagaatcctaagacaaactaccaaacccatgagtataaagaacacacgcatagctgaaatttcaaatgcaaaatccaaaatgctaagtaaaggatctgctgtataattctaaaagtttaataaacctctaaggatggatgaaaagtactttctcatgtactagaacagctttaacagagctgccttaataactcataaaaaaaaccttcatgttcaaagagagaatctgttaattctaaaatgatctggaaaggaacaaaaattaaccaagtatgataccacagaaaaatatctaatggaaggggaaaatatcacgatatattaaattttaagaagtagattactgaacagtatatttaatatgattccaattaagaaaaaaatttaatatctctatatttgaggagaaaaagaatacacacaaaaataatcaggattatagtaatacatatttcattctctttgtgctttctatagctctgaattttctacaatgaacacttcttaaaatatatttttaaaccaagattatgcaaaaaatgtaagaaagaaataatcataatataatatttgacgaaaaaatctattatggttacaactgtatcaagaagcacatgcctaggaaaaagactggaaggaaatacaccaaaattctgtgttcaagtgatca

SEQ ID NO: 1352 - DNA, 1558 bp, Homo sapiens
tagtgccatgatatgttgatatgctgctgttcttagttttaaaaagtacgtgagaggccaggcacggtggctcatgcttgtaatcccaacgctttgggaggccgaagtgggtggaccacctgaggtcaggagttcgagaccaagcctgggtaatatggtgaaaccctgtttctactaaaaatacaaaaaaattagccaggcgtggtggcgcatgcctgtaatcctagctacttggttggctgaggcaggataatcacctgaaccccggaggcagaggttgtagtgagccgagatcgcgccattgcactccagcttgggcaacaagagcgaaactccgtctcaaaaaaaaaaaaaagtgtgcgagataaatacttattgtatagctcattcttctgggcattttaattcatgattttgggagtgaattgctctttcacctacagtgtgccttggaaatggctttagcacatggaggggatccttggctcctaggctttgattcctaccctgcatttggctactggctttatgttcgcttataccttccctccacagtctgatccggtttttgcctttttcttatagcagtgcacatgggatctacccaaaggtataatttacccgtgctggtacttctgacagcaatagttttcttttttaaaacagctttattgaggtgtaatttacataccataaaattcagaataaagtgttttctagtaaatttatagatttgtgcaaccagcaccactgtctatcatctgcccaaaatttcttgtgatcatttgtagttaatcctcattttcaccctcagctccagagaaatactaatctgctttttgtctctgtagatttgccttttctagacatttcatatgattggattttgttttctgacaaaaaaattctaaagcctcagaaaatccacatttcaaattctgaagctatgttcttatattgtggttcatgtgtaagagaaagataatacagtatcaaacagtcaaatacttttattatttcctggttagcagactttttctttctctcgtaaaccaatatctctgatttgaagttaccttagagtgaataaactgtactgaacactgctaagccaatatatcatgttggaaagtaaggaagaactgtggggaaagagtattcaaagaaataggataaccaagagaatattgattattccaaatttaaaagatttatttatacattaatttttatattaatgtaatattacactatgtagttgttaactgtagccttgattacaaatagcaatttataaaaatgcctggaatatttagatttataatttaggctattaaaatactgctattatattcatttcctgttatattaaagataatggattttcataatatctcagaaacaattatggattaagaccaatatttaggcaagaaaagtaaattagtagtgttagagtaacaggtgtttgtacttaatatcatgttaaggtttgacctccagatgatgtaaaatagaatgctgacaactcattgacatgattcaaggcttgtagaat

SEQ ID NO: 1353 - DNA, 4586 bp, Homo sapiens
ataagaaagggaagaaaagaaagaaaataatttaaaaacaataaaaaaaggagggaggggcaggttaaggaataattgaggcaaagagaaaaaaaagatagaaaaatataatgagccagagtaaggttatagaaaaaaatcacttatgatatggaaaattcacttacttgtaactcagcaaggcagggctgaaaggctagccataaatgtgtaaagcactattcaaaggttattattgctccttaatgaatggccctatttggaggcaaatgattacacagaattaaaagcacagacgcacatttctcagctcacctaagtccctgtgccaagattctggttatcacagaggagaggtttctaaggccacagcacacaacttaagaaaggaagcttggatttgttgccaacacttgcaaattttcctaagggtttctgctaatttgcagcacatagcaaaacaagtgtgaaagtatgaaatgacgcatgctaaagggaaggttgaaaaagcggggagaaggagagaatggttctatttcaggaggatgcctgatttcattaaaatcaactgttaaccttttccttacattatatttactgaatcactataattttacaaataagtctgtatctcagtcttatccataaatctttctgtgaagcaagcagaccataagattcaccccaatgaagtcttctttgttggccaaagcattctaacagaataaaaacttgtaaaacaatgtgcatttgaaatagtgtacagaaagcccagtccttgactgggcaaagtaactcatggagtagtaagagtacagcgagagggagggagggagagaaagacagaaaagagaagcagtctgactattttactaatttgcttaaaattttttcaacaaccctgttatctgtaaagggaggaggcagtgctgagggactgttgggtaaaaccaacactcgtctaggttcatatagagtcagtaacttacaaggtacccttgggtacatcatttatctcctttaaatttcagctttttcatgtggaaagcaagaaaatgtttatgaatattgtaaatattttcctctatatgtttgcttcactgagatcactttacagagcacttaatacattgcatggcaaataagaaacaccagaaatatcttgagtattatcactattattagtttcaacgtggactggtagatttggaaaagcctccagaggattatgcttttatttctacatcagggaactcaggaccagggatgcttcctaactttctcaaagtcattcaacatggatgaagctggaaaccatcattctcagcaaactatcgcaaggacaaaaaaccaaacactgcatgttctcactcataggtgggaattgaacaatgagaacacatggacacaggaaggggaacatcacacaccacggactgttgtggggtggggggagggggagggatggcattaggagatatacctaatgctaaatgaccagttaatgggtgcagcacaccaacatggtacatgtatacatatgtaacaaacctgcacgttttgcacatgtacccttaaacttaaagtataaaaaaacaaaaaaaaaaaaacaaaaaaaaacaaatagaaagatggcctcctggtccatagtctacagtcctcctggatgacaaagagaaccactttctttgaagttcataaaaagggaagaatttagaaaataggccccacagtggtttatgaacttctagcatttcctttaaaagcttctacaaacattattagaaataaatttctcctgctttaatgccatattcaccatattaccatatgacactaagaacacaggacaggttgtcagtaatcaccccctcccttgcatcaccttaactcccactgggcacctgtctaaggcatcattttcatgtaggcattatgtgaaaaataaattttgaacacatggctcatgtgtttaaaatgaaaacttcctgagaacaagtgaaaaaaattcatgttgtataccccattgtggatggtaattattttctgtgatcccgctacaggatcatttgcttgtccaagatacatttacatagagttcagccatctcatctttcagaaacaaaagccaacataattttaacacccacttcacatttcctttatgaaagaagaaatcagatccatcctatccatttcttacgatagcaagcacaagtgtacaattttacaatgttttatcttgaactttgctgtggatagttatgtacatgagtcacttttgttgaatctgatgtggatttttgaatagtgttaaatgatttaatacatttccctgttgagactctgataaataatactcatattgtaggaagactttaattttatatttcatataaaatctggattattattacaaagctggcttaacagatgtgcaggggtgtgtgtgtgtgtgtgtgtgtgtgtgtgtgtgatgtttcgaagtcattgtaaaaggaaaagagagcatcaggatcacacactaataatgtccaggttattatctggtgcagttactcttctcctgaacccaccactagaatcacagtcattgcatattagagtagaagggacctcagataccatctagcccaacaacctctttaaactaatcaaactgaggctaaaggacatgaaaatcatacatttcacgatagagagggagaaaggcagggagggtgtgagggagggagagagaaataaagggagaaggaaaggaagagggagaaaggcagggagggtgtgagggagggagagaaataaagggagaaggaaaggaagagggctgaagggagggagggagagagacagaagaagagagggatggagggagagaggaaagaagaaaggaagaacaaaaaaagaaagaaaaagttaggaagaaaggaaggaaggaggaaaggaggaagggaaagagaaaggaagaaaggaaaaagtaacagagaaagagaaagaggaaaggaaagggaaaggaaaggaagaaatagaggttataatttgattcagccttcttaaaaatttattctccatcttattttataatttgtatatgaagaaattacgaaccaggcaagttaggatttacatgaactactcagagttgaacagttgtttactttatgtgggttttctgctaaagaataacaagccacttgcatattaaaataaaaagtctaagagtcattaacagaactgcacaggcataaaaataagaatgttcccctgctcccctaaaccagctgaaaggctgtttagatttttgctcactcatagaacaatcatacaacaaaacaaaacaaaaatgagggccagagccaggaatcccatgagatttcctgtgacttaagtcctgacattaatgagagcatgagactgctgcttcgtgactgccagtggctcgttatcaccaagataaaggctgacaaagtatagtaagagaaagtttgttctctattacaatctgtatttgaaagattcagaacaacaaacgcaataagggggaagtgcactgtgtatgttttacttgctttctattgcatcattagttttgacaatttactctgacatcttgtaattctgatcatttttattctgataaaatatgaaaactcaatcgtcaggcaaaaatttcaacatgtttcatagaatacttttgcaaatgaggtaaaagtgcacaccttcactgtagttagttgatgaaaaaaaaggtctggttccttaccaattgctttcccctcagtgtcaacatgcacaacgaccaaaactggctgacattagagaagttactaagaattcacaggtgcctacctctgaaggctgctagctgcaaaaacaaattcttaagacaagctagaacttatcctttttcctttaaatgtgatagcatatcattataaatcaggtattaggagagccttctaaacaaataaatgtatggatttttttttaacaggcatatgaaaacatgctaagattagttatttaaaaaccaggcaactccagagcaaagtgatatttaataaaccacatgctccttttttttaggatctatttcaaaatctatcaagttttctgagtggcaaaatgattttatccttggtttttctcttcaattcttataattgtaacaaaaaacacataacttacaatatactatcttaaccatttttaggtatacaattcagtggtatcatgtacattcatatagttgtacaatcatcaccaccatccatctccagaattctgcatcttgcaaaacttattttatgtattaaacaagaaatcaccatttccccttcctgccaaccaccattctgctctctgtgtctgatttcaacaactctaggtacctcatataagttgttgcataaaccataattaccttcctttttgtagccaaataatatccatcatatgtagatgccacattttgcttatccattcatctgttggtggacacatgggttgttcaaacattttatctattgtaaatgatgctgctatgaacatgggtatacaaatattcttcaagatcttgcttctca

SEQ ID NO: 1354 - DNA, 1857 bp, Homo sapiens
tgtaccctaaaacttaatgtataaaaaaaaaaaagaaaaaaatcaaagatcttacatggcaaaacccaacatgaatgaaagccaacaaaatggggaaacagtttttatagctcatatcacagagaaagggtaaattccttagtataaaagaactcctactaatcaataagaaaaaaagtctgaaaatgcaatagaaaaaaatgaacaaaaattatcactccacaagaaatgaaatacaaatgtctcaagacatcagaaagcataatcaacttcattcataataagagagatgcaatttaaactatactgagttaccacttatagtaagtatggttaactactacaggtagaggaaaaaggtaggagaacatgaaataggcataaaatatacctgcaaatttgcaggaaaatgtcaacactgttgcttgtcgggaaaccggatggttgagagactgagaaggaaggaaaatgtcagtgtcttttttttttttttttttttgtaccttgagaattttgaatcatgtgaatgactttgaaacatgtggaaaaaataaataaaatttaatttaaaaaatcaattttcatttcaccattctactttgctcagctgcagctggcctctgctttcctggcccctcttcaagaactgcaagagcttctcaaagtcctcatgacatccagagtggttttgtagctcatgaaatgaaagtcgtcctcagaacattgccaaatcgtttcacattttaacgtgatgtttctgacagagcagctgtggcttcatttagcagaatatttgagcatcttagtctaaatacaacagttgggctcctagaacaaaaggttgtggggatgcatgtgtaaaaagtctggaaaagactgtttttctctgtggcatatactacatttcagaactggaattttatttttactttattattctgattgggtttaacacgataatattataaatagtataagtaatatttatcccaattccaatacgcaggtatatattttgctttttgtctcttcactcttataaaatttaattattctccttaacagtactgggtggagtatagtagaacatcagagcaaggaagaacctgaaagttcatttgatggtattatttctcacaagaatctgtttgctgggtatcaagggaataccaggtgacctctttccctctgtatttgaatctattgtctatttctcgaaagactcaatacaacaatccatttcaggtcctgaaatgacatgcggggccaggatggtttctattaacatatgcaaagccccaggagggtgggaaggagaacttgggagaactcagaactgcagagaccagcctggcttgaagagtcttaggaaataccatgagatcttgccaacatcataggagcaagtaattctaacttagttcaaataaacaaaagttacaaagatttataatacaggttaagccccctccacatggcacagtgatgttatagttcaaccttttcctgttttaaaaacagaggaaaattcatcccttagtgaccttttttttttacctcccagactaaccctcttgaataaccataataatcctcaacctttgataagcatcaaggaaccaagggagaaagaagaattaaacctacaagtataagctttgcccccagtatgaaagagacacagccaatcactcttcttgtggcatctcacatcctgtgccactcagcacctgcctttgatactagaagtgtccccagatggacccagcctttcctgacattttgacacatatgaaatatgtccatatcaaccatggaagttctgcttttattcaatgttcacatctgccatcaata

SEQ ID NO: 1355 - DNA, 2778 bp, Homo sapiens
gggaggctgaggcaggaggatggcttgagcccaagaggtgaggttacagtgagccaagatcgtgccactgcactccagcctggacaacagagtgaaaatgatatgatagtggctctcatctgctccccgcacccgaccactggggcagattttaattttttaaaaataatcatctgatgctgaatttaaaactttggagggaatcaaaagagaaggtcttgcactcctgttatccaagagacataaatacatgtgtgttttccttttaggccgaaaacaagaacaacattcctggcattcaactacaaggaagcccaataccccgggtgccataagacttccagtatgcctgcctgagctttgaaagagaggagaggaagccaagtcatccagcagatcggacccacaagctcatcctctagtttttttcaaggggcaccattcctgtaaggaaagctttcttgggcttggctgtagaatcttccagaaatgtaaacaaaagagtaagagccaaagaccaagaaccctggctggtgagagtcagagggccagaatttagtgtaaagcccgctctaaagactgttaacacttcctttccaccactgcatcgatgattgtttgaaaaagtgattgtttgtgatagactggattaagaaaatgtggcacatatacaccatggaatactatgcagccataaaaaatgatgagttcatgtcctttgtagggacatggatgaaattggaaatatcattctcagtaaactatcgcaaggacaaaaaaccaaacaccggatgttctcactcataggtgggaattgaataatgagaacacgtggacacaggaaggggaacatcacactctgggaactgttgtggggtggggggagagggaagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaataagaaaaagtgattgtttgaacaagtgtatcaatgattgaacaagtataaaaaaggtttattatgcctttaataaaaaggaacatatacatatcaatctaaaagacctctaaggtctcaaaatataaatgggcaacaaaaccggacagaatttacagaaaaaatgtctaataaaaatacaaatgtctagtaaccatgtgaaaagcgtttgcctggagtagaaatcaaaattaaaatgaattaccagtttttgccaaacatattaccagagatgtttttaataaacattttccaaaaaaaaaagagtgacatgggcaccctcatgtctgatgatgggagtatattaatacatcttcaaaatctataaaatgttaacagataagagatactgacagggctgattctaacctaaatactacaaagaaacatatgctgtgggtatggagtgagagttaatatgtcccggcccacctcatgtctaaatatgctgaaacagcttctatttaaaataagtgctgtcctccagctgtagcaaataggaagacaagtatcttcatgctgttgacctggttttcctatcgtgattcacgaatgactttaagaaagagctaaatcaactggcaaactacattagaaagaagaatttagggccaggtgtggtggcacatgtctgtattcccagtactttgggaagccaagttgggcggattgcttgaagccaggcgtttgagaccagcctggccaacatggcgaaaccctgtctctactaaaaatacaaaacaggccaggcacggtggctcatgcctgtaatcccagcactttgggaggccaaggcgggcagatcacctgaggttaggagtttcaagaccagcctgcctaacatggtgaaaccctgtctctactaaaaatacaaaaattagccaggcatggtggcaggtgcctgtagtcccagctactcacaagactgaggcaggagaatcacttgaacccaggaagcggaggttgcagtgagcccagatcataccactacactccagcctgggtgacagagcaagattccgtctcaaaaaataataataaataaataaataaataaaaatacaaaagttatccatgtgtgcactccagcctgggtgtcagagaaagattctgtctcaaaaaaaaaaaaaaagagttgaggtagaacacattcagattgacagtatattcccgatatatccctccagtaatacacacacacacacacacacacacacttgcactcacacatgcacacttgcttcatgaaattcttttttatctttatgccttttcaaaacatacctcctttcaatcccctaacttctgtttaaccactttcccctctctaccagccagttttcctctgtctgaccttaaataccccaaatgctttacatccttggctttcttctctttcggtcttacaccttcttgatgaatgtgagattctcagactctgctattgcttcaagaacccttatctctatgcaatttccaaatccatacctccaactctgtatgaacttccctcacagatactagatcaatatttcttgttttgactttaaatacacacctaaaatgaaattttcctttcttacccccatctcaacttctttctgtcctatatttatttattcacttgtttattcactcattccacaaatagctaacaagtaccaggcattattactgcctggtact

SEQ ID NO: 1356 - DNA, 1292 bp, Homo sapiens
tttctctccagtggtagtattcctatgtctcacatttctttcattggattcttctttggaggagctaagggcagaaccaagctaagaaacctgagcaatttattgtcttcatcactggtttcagaattagcagcctatgtttccatcctcccaaacatttcagttatctcagcacactagcgtgaagaaagatatgaatgaactagcatgaagcaaataacactgagtgattccttctcctgtccaccccccactcctcattgttgtcttctagataccagcaactgaaaagcagaacaaaaacacttggatcgtaggctaactcctaaaagattgatccctggtgctgatacaggtatggacatcctgacttgctatttctgggtatctgcacgaggaatggcagctggatcagagtggcctggactgcgggcagtctttagttttattaggaacacagggccagatcaataatcaattagagttggcaggggaccagggacttggagcataaacaagtcatgaagggctaagaattcagttcagctacaaagcctcctgtagaaggacccaaaggatgaggagccagcagactatttggaataaggcatgtggcatgcggcctgagacagaacaagaagtgcctgagagagaacaagaagttctttcacagaagggagtagggactgctggctaaaaagggaccccataaagcccacaaagcccttctgtgatacatgctttgctggaaagtctggctggaaagtgggagcaaggccaagattccatggaggccagaggcctagaccaagtcaaccccacattccctaagtcacctttctttgtgagcatgttctatggaacaagtcccatagtaaaataccaaaaacctaagagttcagttgcacatgtgtacctttttccttttataaatattcatgactcctcctatagcttattaaatacatatattcagccaccttgttcaacataaattcctgtcccctttgcccctccctcagtttgtgtttctgacttctggccagaggctgtacttcccagactgtcagaatggccaccctgcagactgcaaccctttgagaaataaagctctcctttccaatttttaaaaataaaaaaacctgatggtaaaggaatgaagctgcttttgttctaatctgcatttcccaaaaatgatttgacaatatattttgtttggagatggagtctcactctgttgcccaggctggagtgtagtggcacaatctcggctcactgcaacctctgcctcc

SEQ ID NO: 1357 - DNA, 2866 bp, Homo sapiens
ggtatatatgtggggagttacagatggttattataagtacatagataacctagaattgaaattggaaaacaattaattctgaaacaggtatagggaccaactactttctccacatctctcacagcctctctatttctcttaacaactatgtttcattcttattcttatttcccaactggccagatttccatggtctccgctccctcataattttagtctgtttccagcttatcataactgttctgacctctctacctcacaaacatttccatgaatatctccatccaactgctggttctccctgtagtcctagttcaaattcttaaggagggaatctgattgaccctagctcatctgttcatgctaggcaatgtcagcaagggacaagatcctatggctctttaagcaaccaaagctagaaggaggtattctctttgctcagctcctccagtggaagatataactcgctttactctaaagtaacttccatattgtttctggtaaatctctttctcatgaattgtgcgggaaggggcctcaggggcctcagatttcttctagtccaatgctttcattcagggctgatatttacattacaaaaggtcctgtcctttacaaaagcctttactatagggttttaaaaatagcacatttctgcaatgaattttaaaatacagcacacaggccaggcatgatggctcatggctgtaatcctagcactttgggaggctgaggcaggaggatcacttgagcctaggagtttgagaccagcctggacaacacagcaagaccccatctctacacaaatacacacacacacacacacacacacacacacacacacacacaccacaaattagccaggttgcatgcacctgtagtcccagctactcaggaggctgaggcgggaggatcccttgagcccaagagttcaagactccagtgagctatgattgttaccactgcactccagcatgggcaacagagtgagaacctgtctctaaaataaataaataaataaaatgcagtatatatataaccttaaagaccttgatttaggggatttatattctggccatggtgcagaaatctacactggactttccctcacactgtaaacagcagtaagcctggacacaatatatgacactaatgtttttcggtattggacaatagacaacataggacagtgattcctgagggaaggaaaacactcaacgtgagtcacacatttacccttgctctctgcctaaggacaatttcttgatcatggctcagagaggtagatccaaaggagagcatgatagtaccagggagtaacacagatgttggaattagcaggcaatgtctttaaagcagctgttataaatatatttatggacataaaggaaatattgttttaatggatgcacggatggagaatctaagcagaaaaatggaaacagtagaaaaatacaatatcagaaataaaaaattcgttggataggcctaacagctgaatgtgaagatggatccatggaaattatttaatctgaagaacagagaggaagaaggcttttttttttttgagatggcgtctcgctctgtctgccaggctggaatgcagtggcgcgatctcggctcactgcaagctcctccttccaggttcacgccattctcctgcctcagcctcccgagtagctgggactaaggcgcccgccaccacgcctggctaatttttttttttttttgtatttttagtagagacggggtttcaccatgttagccaggatggtctcgatctcctaacctcctgatccaccagtcttggcctcccaaagtgctgggattacaggcgtgagccaccacgcccggccaagaaggttttgttttgttttgttttgttttgtttttcttgtaaaaagagagcctggctgggcatggtggctcatacctataatcccagcactttgggaggatgagacgggaggatcacttgagcccagaagtttgagaccaacctgggcaacataaaaaaaacctcgtctctacaaaaaatttaaaaattagccaggcgtggtggtatgcccctgtggtccctctatgtgggaggctgaagtggaaggatagcttgaacccaggagatcaaggctgcagtgagctgcggctgtgccactgcaaagcagtctgggtgacagagtgagaccctgtctcaaaaaaaaaaagagaaaagaaaaagaaaaaacaggtgccctgttactgaggctccactaaaaaataataataataaaagagagggcctttgtgagctatggaatatattatatatgtatttggaacatgggtgtagttggaatgccagagggaaaaagaggaagaaaaaatatttgaagaaataatggtcaaaagttttctgaacttggtggaaaacatataggactatcagaaactcagtgagccccaagcaggataaatacaaataaaaccacatctaggtcttttatagtcaaactactgaaaaccaaagataaaactaaaaccttggaagtagccaaagaaaaatgacaaattgcatacagggaaacaattatatgaattgtggttgacttctcaccataaacaatgtaggccagaagacaatggaatggctttttttttttttttttttttttgagacaaggtcccactctgtcacccaggctggagtgcaatggcatgctcacagctcactggagacttgacctcctgggctcaagtgatcctcctgcctcagcctgccaagtagctgggaccacaggcatgcaccactaagcccagctaattttttttttaatatatagagacagggtctcactatgttgcctaggctggtcttgaattcttggga

SEQ ID NO: 1358 - DNA, 2518 bp, Homo sapiens
acaaaatgaatacatgcaaagctcttcaaacagtgcctcatacattctaagcactatatttgtgtttgctgttatatgattataattgacctaggtcatgatgcaatttcttgccttttgctaagacttgctatttatacagatcttgtacaaataatggcaagtcaatggccaaactgcagacgctattgtggtaatgggattggggtggaggaagaactgctctctcatattcctgggtactcacctggtagaaaagctcctctgctctcagcagcacatctctgtttcattagtgactaaaatatgttgcctatactacctcattgtagagaaactggataagtcagccatccagacaccacatagcgaatctctggtacacccgggaaaccagggcaaccacactcccacacagatgccctgctgttcttactggtcgccatgagttcacagtgaatagtctgctctgaaaaagtttgaaggtagcaactctgtcatcctgactgctgcacattacagtgggaatagttctgcatctgagaagtgaccctatgctgatgttatgccatgccacaccacgaggattcccgtgtggaaccccagagtctggccagggatgttcggactggcatcagttataatctgcataactgacagctgggagatctttaatgtttgttttttacttctcctgaaatgatatggcagtaatataggaatttccattactttggatcccaaaccctaacagctgttggtcaaaattcttcaactctagggaaccgatttgaaataactctttcaaaaggaaataggttccaccatcactggagtacccaaattcttttttttttttttctgggactggtgttgaggaagaggatccaaaaggcaaactgagtttcatgaaaggtattctgaaactttttttttttgagacagagtctcgctctatcacccaggctagagtgcagtggtgccaactcagcttactgcaacctccgcctcccaggttcaagcaattctcgtgcctcagcctcctgagcagctgggattacaggcatgtgccaccacacccagctaatttttgtatttttcagtagcgacggggtttcaccatgttgaccaggctgatttcaaactcctgacctcaggtcatccacccgccttggcctcccatagtgctgggagtacaggcgtgagccactgtgcctggcccgaaacagtttttatgaagttaaaaatattctgtggatttagagtaataccatctttaaatcactcatgatatccaagtaccctgcaacaaattataatttaaaatttaaatataacatcacagaagatgggagagttggagccagaatgagaaattagggtagcagaaaggggtccaagagaaacataaggccagcatgcattttaaagccaggaatgacaacatctatttaaaccctcgtgtttcatgggattgatcatggtttaccacgtggcggggtgtagtgcaaaggacaaactgcagcaccccccacccccttactccatccacaatgtgtactgagtttctgccgctgttaacacactctagattagtcgtgccagggatgctcctgactgttctatcttttctctccccactgacatttactgagaacttgctatgtgccagaatccttcaaagtatttcacataaatcagtgtaaaagcttacaacacccctgtgagctactaccctgctagatggtaagccatgatcaatcccatgaaacacgaggtttaagtagatgttgtcatttctgcctatattatgttatcctcatttttcagaagagggaaatgtggcacagagaggctaattaacttgccccaggtcacacagctgtgaagtggcagaatagagattcaaactctggcaatctcactccattgtaaacccctagttgtgcaactggggcaagcatgtcatctgtaaacttctccatttgtctataccatggggttaacaacacctacctcacaatgttctctaccccatccattttgaggagtaaatgagattgagataatgcatgtgaagggcctaatactttactgatcatagatttcttcaactaagctgggaaatgctacaacttaggcaaagctataatgatagacattttacttctacaatgaaatcataattttgagaaaatcataaaagaatgaaaaaaatctgatctttgggacaggctagttaagatgaatatatgaatatttgataatgaatgcagcttgccaaaatgcatggaccacaagatacctatacaccatttgtaatctaatctaattgcattagcttcacaaatacaggaagaatggagacacaaacaccacactctgggtggatggacatgaagcagtctctgtggttcaggtagggctcagcaggccaccctatcttctggttgaagagcagagaatgaagtgggaatgagagtggaaggcaaggtggagatgcagtggagaacaagga

SEQ ID NO: 1359 - DNA, 1398 bp, Homo sapiens
caagctgggaggtaagagaacatctggggtctaattcaactggggagaacagtgagagagatgtggctctctagataatgatgatcttggccaagatgtgacaatggaagtagagaacttttaagcaattcacagacattgaaaattaaagtcagtgccaggtgcggtggctcacgcctgtaatcccagcactttgggaggctgaggtgggtggatcacgaggtcaagagatcgagaccatcttggccaacacagtgaaaccctgtctctactaaaaatacaacaattagctgggcttggtggtgcatgcctgtagtcccagctacttgggaggctgaggcagaagaatcccttgaacctgggaggcggaggttgcagtgagccgagatcgcgccattgcaccccagcctggtgacagaatgagactccatctcaaaaaaaaaaaaaggaaagaaaattaaagtcaatacttagtctttttttcaaatataaataaattcaacattctccttgtgaacagacaattgaattgcttgtgcttctctaagagcttttgaaattatttatattaccctcatggcgttgtgtcaaaatgaaactattcttatatttttaccataagaaacttgtcaaattttctgtatactcaagaaaaatgggaatgattagaaactgtgaaaagcttggtatctatttatctgatattttcttgaaagaattgcatttttctaaccactttattaaaaaaataagcaaagcttatactttcaacaccttgtattataaaatgctattttgcactcttcctctgctcctaaggcataattaaatagtatactattgggctttttgtataatttatgtttgtattttatgtatctttagaaacaaggatgagaataaaactggggaaagaaagtgtgaaagcaaaataagaatagcttttctttgtcatttaatatgtaatgataagttcattttaattatgtgtatttgcttatcctaaagcaataatttgtttcatgaaatatgtaatcagaaacaacatagtataactctctatctatctatctatctatatatatataaacttgtactaacaaagacacattgaataataatctggaaactactcacagaaatcattatgactatagagaagttgataatatatggatatatgcatccactgggaattcaagatgagtgaggtcttagaggcaacatgtatgaagtacaaaagcagagttataggaattaaataccctgcttcatacaagtatatgcagacacttacatctcccaggcctccttgtagccacagtccctgggggttcttggtaacgttataaagacaaagatcagtctggaaacattatccactccatgatgcaaatg

SEQ ID NO: 1360 - DNA, 2202 bp, Homo sapiens
ttttgccaaatttggggactttctgctgttgtgtgtttgaatactctttctttgtttacatattttgttcagctttttgaacaaatcccaaatagagtacacctaaagaaatccatgccaagacacgtcataattatacttttgaaatccaaagacacagaagaaactcttaaaagcagagagagagaaatgacacatcagttgtaggaaaacacccactcaaatgacagcagatttctcatcagaaaccacagaggccagaagaaagtggtacagcatttttcaagggctgaaagaaaaggattgtcaataatgaagtctaaacccactgaaattatccttcgggaaaataaagacgttttcctataaaggacaactaaaaaaattgtctctaaaagacctaccccaagtgattgataaaggtagctcttcaagcagaaaggaaaagctgaaacgaagaatcttggagttatcggaaaggaggaaggaacagtggaaaaggcaggtagacggagacacaaacgagactaggcttttatctgtgagttttagaaaccatatttgatgagtgaaaccaacataacactatctgatactcaagatgatatttaaaaatgggaccataaagaggcctaaatggaagttaggtttccacatttcacttgaagtcataaaatacaaaatctaatattactcattaaaaaacaacagcagcaaaagaaaacctcctgtctcaacctcaccttccccttcactactttttcatctctctgacattttgcagcaatgcttcttagaagagcttcactcaccatcccaccctgattttgtttcccttcataccactccatccaaaaggatcttttcaaagtcctttgcaattctggcaagaatagacagctgatattttccaaattgtctttgagtaatcaaaggcattttcctgtcagctctctctgatgtcaggattattcagaatatgtattttctgagtcatcctccctcactgcctttggttccttgacaatggagctatacacgttaaagcacaaatactcctaatatttcacatgctggcttggatttcatcattcctaacaattttctaccttgaaattaaaacctgcttacatctactaaaggctcagttttaaaacagcacttgaaccagacagtcagtcctgtggggaatgacataattgcccaaagaaccaagccacaacctttttactgtacaaagagtgaacatttgcaagggttaagacttgttctattttcactcttaatttttttgatgctacacaaaattatggcactcccagatatggtgcaaaattagagtcttcttattttttcttatgttgacagaactttgaactgagctattttgagttcagtattttgagtatttcaagatcagtttcaatttgtaaagatgcacatctcagtacagagcaacctccagaggaatgagacccatctaaagtttaggaatcctgttttgcccaaacacaatgaaaaggaaaggaaatgagaatatatgggtatatgtatgaagtgtgtgtgtgtgtgtgtgtgtgtgtgtgagagagagagagagagagaagcaaattagaatgaaaagatgcacttgaaaaaatccattggcctgactttaaatgttcactcaagcaagtcacgtagctcctctgagcctcctgtgtgaaataagaggataatgccaatcttgcaggattatggggatgttgtccatgttgatcacaaaaccttgctgacctctgttctccatgaggaagactcaaagacttgctatttctggctttgttggggtgttggggtgccacatgactcattgtggtcatgagataggagcagagagcacctcaaggatgtgcatttgattttcaatgtgaggtcacacagagctctttggcctgccacatggccagcattcaaactggggccttttggcctggcctctgagcagcagtgatgagcagggagccttggcgatgtgcattgtcatgttccatgggctggaattaaattttggttgttccaaaccctgagatgttcagtcctatgttcccaaggcattatcaaatttctgccatatcaggtgcctgttacagtgatggaggtcagagacgctcattaggcagggacgtgacaaatgctgctgttgctcttgctgtgaaatcc

SEQ ID NO: 1361 - DNA, 2883 bp, Homo sapiens
acaagtgtaaaactgaaaaattcactaaaataattgcttagggccctggagattgacaaaaggtaaagaaaaaataatgtggagcctgattctgccctctcttttattatctgtgttcaataacggtgtcctttctggaaaaaaaaaaaagacacccaaccccattccatattcctcattgtcactatgtaatggaatagaaaaaggggactgttgtattgttaagattctttttggtggcaagtaatagaaacaacacttcaaataagccctagtacgcaagggaatgtattggaagggcactgaagaatatcctgctctcaaagggcaggaagagtagaacgactccctagggcctgggaagaggaatggggatactcttgtggcccaccgagtcttcagattctctatcttgctttctttttctgaggtcttgtgttctcttagcctcaccactttctgtaagtctactttactctcctctcccaaaaggtgttgtcttctgcagaacagctttcactgtgtttgacaggcacatggcaaaatgatgcatctatatgtcttcagtttaagcaacttcccagactggtggtcggattctcaatgtgaagtttctccaagacagtctgattgggtcgtcttgggtcatgtgtccatccttggtctcatcaattattatctgtgggatcaagatcaaattgtacaagcatggctgggtggtggtgatatacactagtatagagttaaacatattcagcagaagaatattcatgtagactaccctataaaaagcctttgtaacaaacagaaaagttagtgtttaatataactttattcagtcaacatgcatttatctttacttcctgaagagaacatcctttgtattgttggactgctttactgtgtaacctagtgcaagctttgtacctattaatctgtcggtatgtattggtttgattattttctgtttcattcacttatagcatatttgtaaatgcttacaggaatcttgtaggttttaactctatctcacaagtatcattcttaaactaatatatgaggttcaaagattatgggtgctttatttcattcttagcatttttttctgaatatgtgcttaaattacagaggagtggggttttttttttcttcttttttggagggtagattaaaaccattagctatacttaggcatagtcctcagtggataagagttgttttgctttcaaaattttcaagcaggctttagtgaaacaaacaatattttcactatgaaatcaccagcatgctagctggaagagctgtgccatcatctgtttatggtggtatgccatttggtatctataattcagaacagcaaaggtaaaatttaaatgtttgcatactgaaaattacttctctatgtctttggaaaagagtattagcaatggttgggcatgtagcaaaaaccaagctttctgtctatgagttgatggctctgcttagttcagtttcttgaaccattacaagccccatgcaagcattgtgctgtctgtcaaatataaccaaaggctgaatgaaaacactgggattagttccacttcctcagaatgtgtcagggacctggccacacctcaccccagccatcccccagtcccagcctggcccatttcatgaggtaccattcaaatgactcccatctgcagcaatacaaattactttccaaacaagtccctggctgcagtgactcccagcatgcattggcttttcccatttactctttgcttcccaaaatcagatgagggtcttgcctaagtatgtgtttcacatagtattggcacagataggtgttcagtgttttgtttattttattgtttctatgtttgtttgtttgtttgagacagggtcttactctatcacccaggctagagtgtagtggcaccatcacggctcactgcagccttgacttcccaggctcaaacagtcctcccaccttagctttcagagtagctaggactacaggtatgcgtcaccatgcctggctaagttttacatttttttaagagacggggtctcactatgactggtcttgaactcttgggctcaagccaccctcccacctcagcctcccaaagtgctgggatatgcctggctgtaagttcgttttaaccagttagttgtattgttcattcaacaggctgttatgtgtgaggaactgcagtagttgcttctgtcttgggccaagtgtcttccctaaagctctagagtctttaaattaaaacatctatataaaaatttccctatttttcctttcttgtttaaatttatttctcaattattcttccataattcccagtttcattaattccttttacattttgtttagctttttcatttgtaggtcatgtacattcgtacattcatgaattcagcaaatgtttgtcaagcacctattatgcacccatgtattatgctagcagtaacaaattgcatgttatatagttgtttcagtgcttcagtatttagttgaagcaacaaatatatacacctaactgtaaccacaagtgattgctatactatacagattatatgggaatatagtagaggaagcagggagatttcctgaagagatggcatttgagtagaatgacaagaatgtttacaggtgatgcctgaaggaagactgctcactaggactgggctgtaatattagaagcaaaggctagaaagtaagtttggagaaatgttacagagggccttgagtaccacattttagaaatatagtcttcattctaggctcttaaaaaatcagtttatatttttgaggggggatagtgacatgaaatcactcatgtttaaggaggatagttttggagatttgtaaatgatagagaatcaaaagtc

SEQ ID NO: 1362 - DNA, 2702 bp, Homo sapiens
gtgaagaggctgaggtttctcacctgggtgattggcacagcctttattatagagagaaatcattattaaactacagagagaaaatggcacgtaaacaattgttcagttatttctcctaaatctataatcctagattatcatggtggatgagaccagtcccccaaacattcaccatctgctgcatcaattttactcatcttcgtcctaattccaaagcagcttcaggacatctcttattcttagaaaggtcagccttatactgagttaaaatctgctttcccataatttccagcctttggtcctggttttatcttctagaaacacatatcaagtttagaccctcttctccaagaccctgttttttgttttgttttgttttgtttttcctttggaaccatttagctggctaaaccagaatgccaccattatttttctaatttgtccataaaaacatgaggtacctcatcgaatggtctgctgaaatcacagtacactgtgtctgcctcccgctgctctattagtctattaaacctgaccctctaaaaaatgtggagagggtctaattctgtttgtggtgataagctggacgctaatgaccatcaattttggtctaagtgcatatgaacaatctgtttcatcctctatactggaatattccccaagatcaccaagttgatggtccaagttcaaatgcaatagtattgtaatggaaacactcctctgcaaatctctcagagccaccatcactcttaggaaaagcttctgctgctttcgatctttgatcacaccatgacagatctccccagctgatttttgcatttgctgattcttccataacttactgtttgtataactggttctttctcgtcacctgggtttcagcctaaatatcccacaccagggaggacttccaaaccacctgatctagactcaaccaattcccattcactgtcccattaccctgcttcattgtttgcatagaatttaaaaactatctgaaatggttttgttctttgtttgcttaccatcaaatagaagcctcctgagggtagggattttgctttattcatgtcgtagtaccagcattaaggacgctgcctggcccagagcctgtgctgaataagaacttgctgaataagtgtataaacatcactgccttagaattctaactgcccagcctcccatcctttcagctttcacaaaccccagaatgatgttgttcttctctcttgaggttcctgtcacatccattttgccaagcaatttttcctagttgatcagaattaggtccagaacagaagttccccaagtctcttctgctcctggctgaaagatgaaattatcagccaagtcgagcaagacaaaatggatcagatgccctgtgtgaggctgaatgaagctcccagcagttactgcccccacatcattcctcacagggagaggccacatcccccagctgtctcttttcatcataggagctccccagcttcaagaaggggctggatctgctctggcattgtcaaagcaagtttaccatgaccgactgacctccttctcctctctctcttgagttcttgactcttggctttaacaactgacatcaggccagactctgatagcagctccaaccatggaattataatcaatgtgtaccattggttgcatgagtcagaaaccctcaaactgaaaagaaaaaaaaaaaaagaagaggagtaaatgaaattcaacagagagtctcatagaccccagggtaataggcaggcaactattgttattgttattgtctctgtctctgtcccctgcccctctgaggccacatgctcttgaatccttttttctttctgcagagctgagttatgctcctttgtttaacagctggctttcactcctggatcatggtttctctgttctccaaaaactttgaagtacatgtgctatggctttccctttgtcacgttcaaacttcccctcaagtctctatgacatttcagctctgatccaccactgatttactacagtctttagcctgctggttcaagctggccaatgaatcgtcttgtattttaggtacgtatctttggtccaatcagacgtagctcaagaggccatcatatggttcatagagatgctccccacaagggcagtgaatgggattttctgaggtagaatgtaggaaagggagatatctcaagacattctaattcgcatagcatgatatccttgctaaggtgactatttcttgcttggcgctgttttgttttcctagatcggagcccagaacaaacctttgtacattctagacccgaacctctcttccaaaggtggaaggggatcccatctgtgcagcagttagcagttctcattctgttcttactgctggatttcagctgcttccagcataagcccaacatacactcatatctagagactgacacctactgcactagatacagttggtctcaaccatgagtggtaccatcaccacaaggggggtatggaaatgtataggagtagctgtgaattgtcccagtgactagggttagctgctggcctttaatgggcgggggccaaagaaccttaatctcctgtagcatatagtatagtccctctcaacaaagatgtgtcttgtctaaaatgccagcagtgtctcctttgaggaacacaagtcgactgataacttagccaatcatccatgcttatgc

SEQ ID NO: 1363 - DNA, 2105 bp, Homo sapiens
ggagcaataacaatatcagaacctgtgttttgctgctaccagtgcctgttttcacaaccatgctcttctcttctgggtcactgacttggctagtgagaaatataacattccctctgtctgctatactatttctttctgcttgtatactgatgacgcttttacttcattcatgcctctgcttaattgtcacctcctccaagaagcctgacgtgatcactgtgtataaagcaaaactttccaattccttatccttctttatttttctttatatcacttataaccactggaaatacatgtttattttctctctgctgctgccccatccccatctcttcccagaatgttatttccatgagggcaaggaccttaatctctcttgctaactgctattttaccaacatccagaatagtacctgacacataaacctgctcagcacgtatttatgaaatgactgagaggatgactgaaaaaccctgggtcagatagttaaatatccgtttaatgtcagatatgatctttctcttgcaggaccctggtttctttatcagtcagaaaagatacgaagtgccagacctgaggcttccctgtaaatacgggaagggctaacaggacgggtttaggagcttaccaaaaaaataagatatcattattatcattgcaaagcacatgtgcacatactccatggacacagatctttcatcctctccaggtagaacatcccaggtgactgccaaaacttccctgggctgggatgcacaggctagcctcaaagtgccagcttttgccacacccaggagaaaggcctccactaagccaaatcagtgtctcagtgttaagactattttttgaacagagaagtatggggcagcatttgtggcaccaacacttggtggccacataatattgggtgagtcacttgcacaaaaccaaagtaatgataacacccatctttgagggcacttgctagaatcaaatgaactgatcattttacaaacactttctgacatacaaagcttaacactgatgtaagaccctaaccttagacgtgaaagccaggctgagcaattcagacctgactgtgacttgggaacaatgggaggattccgagcgaggaacagacacattaaggcatatctttgggaagcaaacctggtagtgtgtgcaggctgggcctctgctgttggttcctttttttccttctagattgtgcctggggaagggggaggggagagaggtagaatctgcagtgtgggaaatcccactttgactctaccacttgcagaagggagtgggggtggcagggaacagacttgggtgacaggcaccacttgtgccaccctgattaactgggaaaatgcaaatctgcacttccttccccgccgcagctaacaagataatgaatattttcatcagctgcagagaatacaaacatctgtaggaacaccaaacctactctcaagggttgggggaggaggggaggacgcggaggtggggaaacgcagcttctctgcagatttagggaagaggaaatgtgctgagatgctggaaggatggctgggagctggaaatgggcagctctggctggcgcctcccatgcatggtacaacggggaatagctaactgtcctccacccctcatatctgctgttcattcgtggttgtgcatgttgtcactttgtccagcaaccttcaatttattcacctgcacctgcatcgatccctctgcccttccactcatcaagtcactaaacatttgctgattgctattgtgtcccaggcatgaacctaggctctcagagaacacagataaatgagacatcccttgtcctgttgtcttaaagtagctcattcattcacttaatgattaaattcttattaatgaagtacctgctgtgtggtaggtactcacaatcctgttgaaatagacatgggaactggcctactcttgaaggtgctctctgcaagagaagagcgcagagtaggaaggatcactcagcctttcacggaaagaggtgttcaaagaagactcctggaggagttggcggactcctgatgtcaatcaagaatgaatcagagtattttaggcagagaaactagaagagcat

SEQ ID NO: 1364 - DNA, 2207 bp, Homo sapiens
ttataaaactagatctttttctaacctcttggttagaaatcaaaagtgctcaagaaaatcagtcagtaaatggaaatcagacagggctgggtaaatagcgaagtatggtgagaagggaaggatcaaacaaaatggttatcaaagaacaaaactgtgttgagaagccaagcaggcaagctgaatataaaaagctcatggttatgagaaagaattcactttaacaagcttgtttttccattctctccccccagctgatctgatgacaatctcattccaactaaattctcttgtgtcgtaaatctctgtttttccatttcattttttctcacctattttatttttgttccattaaacaccacctccacttccttcctgaccacttcattttctgcctggccttgagatgctccccaagcatctcaacagcttgacttcttcctctgctaggggactaatagctttttgttgatctactggccatctggaagccagagcagcctctaccccacacaggacccagggagagaaaccagtgtaggtggtgtgaggaggcagaaacaaggaagaagaaaaaagaaaagccaggagatataataaggagatgacagaaataaagcaaaatgagaggaaaataggatggaaaaaaggaaagaataaagatagaaaagtctgtatttcaaagataaaggaagattcataagacaaaatgagaggtagaaagtaaaaacacataggagagagggagagaaagggagggtaaatagaagcagggagatacaaaaagtgaagggagaggaaaaaaagaaaagctgagaagtagtaaaatctatacatagtaaaggaaagacacccgaggtgaggaggaaggaagttaggctgaaagggatgaaaaagcaaaatgaagtaatcaaactagttgagaaagcagtgagagacatagccggcagaaagaaatacggagagaaaaggaaaacaaacccagcgggaagaagatagatgtaggcaaaacaagattgagggagattcttagataaaatgaaaagactgtgttttcaagtcgatcttttcccttgcctctacaaagacatcatttcatttaacaacaaatgtgtgcgttaaaatagccgaaaaacaagtaatgccgtagagctgtgcatgcaggggatattgtttggtcagcaatgtctctcaggagaccccaggatttcatttaagctttaggaactatgcaaacatcatcataatagctaatattaactggaaatgtactatgcactcgcactgtgcttagcacgttgaacagtaatttgcatgtaattctcacaacaagcctatgaaatagttgctatcagtatctttgttggtcaatgaggatagggaggcttagagaggttaagataatttgcctaaggttgcacagctttaggtgccagacccagaatcaaatcaggtagtgaaactccctagcccatgatattaaccacttactttccaaaaagaaaaaaaaaaaagccatggtatctggaagcagggctcagaactggacacattcaaccatgttggctgagtcccactgtgtacttggcactaagttaatggccaggagacaatgagagataaataagacgtgatcttggcttccaagaaggtaatgaggcagggctggggagaagatatgtacatgcatgtttcacaattagggaaagcatgtttctgtaggtaagaactaaatgttgtggacacaaagatctggaatgacccttcatgggcaggcttgacaaggaagagtagaacttctcagtgaatgtttttctgtaaaaagccaggtaataaatactttgggctttgtaggctgcagatctgtgtcacaactactcagctcttgctttagagcagtgcagtcctcaacctttttgccgccagggactggtttagtgtaagccaatgtttccacggacaggaaatagggctggtttcggcatgaaactgttccacctcagatcatcaggcataaattggattctcatgaggagtgagcagcctggatcccttgcatgcccagatcacagtagggttcgtgcccctgctcctaggagaatctaatgcccctcactgctctgacaggaggcagagctcaagtggtaatgctggctcacctgctgctcacctcctgctgggcagcctggttcctaacaggccatggacct

SEQ ID NO: 1365 - DNA, 6481 bp, Homo sapiens
tttgtatttttagtagagacaggatttcaccgtgttagccaggatggtctcgatctcctgaccttgtgatccacccgcctgggcctcccaaagtgctgggattacaggcgtaagccaccacacccggccgggaggcttcattttttaaatgcgattttggaagcatcaagatgttgaagattttgttcaaggctgcaagcaatacagacataggattgcattccatgttcctgacatactcctaacctgctcatcacaatgtttacatcaacatcatactcttgcacactccttcagagaaaaatacaaaacacaaccgtcgaacttcctctaattattgccaaggcactattagatgttaacaatctcggatattctcagagaccaatggtcaataatatatcaaaaaagaaataatttggctccctcctcccctcctgaagtaatagtcttggagaaacaggcaatgttagataaaatatctaagggaaacagactatggctaaatgatatctatttccacactagcagaatttgccaattctttctacttcacttctgatttcatacatcccattcactactttctgtaccattaaaagctatcaccacagtcttggtggaagtgtaaaatggtacagccactatgaaaaacagtatcgcagtttcccaaaaaattaatttaccatatatgattcaacaatctcattaatgggtttatatccaaaagaactaaaagcaatgcctcgaagagatacttgcacaatcacattcatagcagcactattcacaatactcaagaggtggaagcaacccatatgtctattgatggataaagaaagaaaatgtggcatctatatacaatggaatattattcagccctaaaaatgaaggaaatcctgtcacatgctacaacatggagaaaccttgaggtcactgtgttaagtgaaataaactagtcacaaaacaacaaatactccatgattccacttatgaagtatctaaagtagtcaaattcacagaaacagattggaatgatagttgccaagagcttgggggaaggggaaaagggagttgagggaattttttttttttttttttttgagatggagtcttgctctgtcgcctaggctggagtgcagcagcgtgatctcggctcactgcaagctccgcctcccaggttcatgccattctccagcctcagcctctctgagcagctgggactacaggtgcccgccaccacgcctggataattttttgtatttttagtagagacggggtttcactgtggtctcaatctcctaacctcgtgatccgcctgcctcggcctcccgaagtgctgggattacaatcgtgagccaccaggcccggccgagggaattcttatttaatggatacagagtttcaaatttgcaagatgaaaaagttctggaaatctgtttcacaacaatgtgaatatacttaacaaactgtacacttaaaaatggttacagtggtcagctttatatgttttttaacccataatttgaaaaggagagagggagctatcatgatacagtatgctggtaggcattccttacttccctaactagaagctagtgaatcttaaagtgctggaagttagagatctgattatctgctctaccactacctcctttttacagataactgaagctaggagtagtacaccaatctttaaagtcaggtggactagaatccaaacactggctctaacactttgctgtgagcctcagctccctcccctgtacaaatgtggatattaaatgaaacaatatagcatagtacttggcacacagtcttccttccctttcaactctctgggatggttcattttgtagtcaaagccctgtcttggttggcaatggtaaacagagtaactatttgaacaaaaaggaaacaggtgaatttttaataaaatagtttgtgtgtgtgtgtgtgtatgtgtatatatatatatttagatcaattcctgagaaatgctgaaattaagccaactacccactgaagtgattctgctatatgttttaatgctttccctccaaaaaaaatatctaattttaaggagagaatggttacacataaaatttatagaatcatctaaaagaggctactcctagaacagccaaatctctcatacattcctggttgaaatataaacttgtataacctcttcagagaagaatgtgcatattctagaacctagcagtgccttgcaactccaaatatggtctatggatctgcattacctgggaacttgtgagaaatatagattctcaggcccacctgagaacaactgaatcaggacctgaatcagaacctgcagtatcataaggtactcaggtgattcctatgcacattaattgagacgtattgctctagagaaactcacctacaagtgaagaaaacatgtgcaatgttgttcattgcagcattacttgaaaaagcaaaaaatgtagaatcagctcaaatgattatcaataagaaaaatgagatattgtggactattcatacagtaggaaactatacagcaaacttgataaagcagaattacatggaacaatatagaaaaatctcaataaaatggtgagtttaaaaaaagcatggtaagagttcattatacaaaatttgaaacatgaacacaacactgtgtgtgtgtgtgtgtgtgtgtgtgtgtgtgtgtgtgtaaacatttttaaatgcatggcaccaaattcaggatagtggttacatctgggtagggaagaaagaaaaagagataaaaaaaaaaaaaaagaacaccaggaggctatgatcatatttaatattttatctcaaaaatgaaaacaatccaaagcaaatacaggagaaaattcagatattacaaagctgggaggcaggtatacaggggatgttcactatattactttttatacttttcagaaaacttatttcatattttttaaaatgaagaataagtttctccccattggttagcatttctcataaacaaatatcatcgtactcaaacttgtactatagaaataatcatctatttgtcctatctaggttttaaaagaacaagttttgcatctgacttatctctgaatgcatcatctcctctccgcaacacacacacacacacacacacacacacacacacacacacgcacgcacacacaacttctcttagggcttcagagatcaagttaggagatttgaaggtcagattcaagtgaagatatggttacctgggccaatcaacatggaaaaacagaatctctgcctggggtagccaagattatggacccaaataggactaactgtaaagtctgcaaaataaggaaggaaaagaaacagtagtgctaacagcagggctgtatcaggtgcaccaaaatcaagtgaaaaagaaaaagacatacatccaagggcatgaatatattcattcattcagcaaatatatattgcctcatatatacctgctaaacattatttcagatgctagggatgtggcagtaaacaaaacaggccaaaattaacgccctcatggaccttacatcttagaaatggacacacaattagttacttaaataggttaagtatttagtatgttagaaggtagttaaatcctaaggaggaaaaacagcaggaaagggagacaggggagatggaggtggagagtaactacatgtgtgttgtgggagtgcaattttagataggatggacataggaagcgtatggtaagtatatgcaggagtttttcattttacatgttctttacacgtgcttctgggcaaggtagagaggtttaaaaggttcaaagcaatgttctgttgataattgaattagtatgaatagaagatagaaaaatatgcagagcacaaaaccagagaactgtaattcttctctgaggtttctagagaaaagattcctggcaaagcacattaatcactggttcaatcatcaacaaactagtgttgtgccagaaatacagactacaatttctaggtgctggagatacaacaatgagaaagacagacgtggtcattgttcttatacagcttaatgtcttatagcagagagaaaaacaaagaagcaatatcgtgtgataagtattgaaacagaaatatgaatagaacattatggtacatgtgtttgcacatggagaaccacctaattcagactttctagaggaagaaatatctaagcatggacgtgaagaatgaggaggtatagctaagctaagggtagaggagaggagtatccccaaggcaaggagcagcatgtgtaacaacatcaaggcaaaagagagcatagtactatagagaactggaaaaagtgcattgtggctgggacacagaatggggtaagaagtggtgacaggtgaaggactttcctaagagcaactggatagccatggaagaattttatacaagagaggaagaataatcagatctacatcttagaaacataattctggctacagtgtgaaaatggaccagggaaagaatgaatgcaaagagactttttagcagcctgctaaaaaaaatccaattgagagatgaagatagccagaaaaataaatgccaagagcatgtgcatgttattatgaccacaggatatttatcattacctgtgcaccagatggtaggctcatatcctaaaaacctagtttttcccctattgtagtaaaaatgaatcatgtgtgccaatgaattatcattgtctcttactcagaaggtaggaaaattgtataaaaatcaaagaccctaataaattgggcccataaaaatgttgccagagttgtgctttataaccacctaaagtcattatgctcttctctaagacagcacctttacttgcacattatgtcaatacctgataacaattttcatcctctcccttcccataacaatttttctacccgttttaacagcttctgagactctaagattcatgactggctgtgtaagaggcaagtacttgcttttcagctgaataaacaaagacagacaatgagggtaatgtggcaaatgggtctgcccactcagatattttccaaagaaggagttcacgctgggctccctcagttggaaagcccaggggaataaacattccagatatataactaaactaatatcaaagtcatacttcatcaagcactattacttctgctgctgagggaatggcatacaaaactttggggaaattacgaggtccaaggacataaaaattaaagaatgggaataaagaaggtaagtacactggggtattttgttgacaaaaccaaacctgacatattaaaacaactttactcacccagagaccaagaaagcaatgaactttcatcaatgccctggagtcagtgtgtgtgtgtgtatatattaaaggatatgtggctatagtcaaagatggcaacattcaaaatgaaaactatttgtattttagggtatactctaaaagactaatgttttgtatcaatgatacatcagatgtagaatgtttggcaatgcttggggcagcttctctatcctttttatttatttcattcaaaatgagcagtacattcctaaccaggtctgctcagacacccagggtgctactgaatggtagtacagactcttcagtgaccaagcaaccaatatcctggaatttgaaaagaactttttataatgaaaagttccactatcaatagaccatttgcctgagttgttttcatagttgcaactgaccctctgctggagaccaaaatttcctctgtattatccctaaagtcactccactagctaaaaattaggataggacagaggaggagggaagtactttaaattctaacataacaaaagaagaaattaggtaatcaaaataaaaatgcccttgttataaaaataatgttggccacagacatttaaaaagaaatataaatattttattgaactcaataaatatgtatggaatgagcatggttccaatgacacattttagcacaagttgtttgcagttaatatgaccattgataagcatttctttgagtcatagtttcttcacatgtagaaactgggtaataatctgtatcctaccctatccaaacaattccaggagtatttatgttgccagttttcatcctcagttgagttactaggtatttaacaatgccagaaataacaacaaaaaaagccaccatttttcattacttgtctcaaaaaatgatcaatcaatcaatcaagtctctagatttagctctagcaacataaatggataggggtgtggatgaggcaggactggccatggagtgatagttggttgtgcaggtgggtgagagatatgagaaaggtcataaccctactctgttaattttggtatatattcaaaattttccacaatacaaaagtttttaagtatctttacgttactctcacaggcatattttcctagatacttttggggcatctttgccacaggccactgatgccctgaacaagaa

SEQ ID NO: 1366 - DNA, 3184 bp, Homo sapiens
cttcctccattctttgttaggctaacatctcatcttacaagccatgctcaggtgccatagttccaggaagctgtccctgcccccatagccatccctcttggggtcttcctctggggtcccatagcactctaagcttacctctatcctattaaataaaagtcacctgcttatccgccagcctcccccttgaggatgtgaactctctacagatagggagggaactgtcttcatgaccttaccaagcatacagcctggcacacaatggcacactgaacacacgtgtgtcgaatgaatgaatacgctacactcttgtatgggagtgagtcccatgaaatgaagctgctttccgaaaagtaaaaggataccaagatagtttcaaacagacatacactgtcccagaattcttcctgaagcagacggcgtcacagcaaggctgcaattatagacatgcgcacacattgtttaaaaaaattcatagaatgcacttcacactgactttttttttcttattggaaacctgtttacaatcttgtccactgtcagtcttaaatgtcacttttcagaaagctggctgctgccagcagaaatttattttcaacttgaatcacagcatgttcatgcagagaagcgcctcttttgaatctccaaattggagggaattcagggaagagaaagtgaggtgattagaatctgcagaggccgactcaggaagaaaaattatgaggctaaaatatgcatgtgtgagctaaacagcagctattagttggtggaggtggcaatggtggggatggcaactacctagaaacctaccaggacagtgaggctgcatagcaacacgtggaaacaaggaagcgggagcgggaggaagaaacagtgagggaagcccaggcaccaggaaggacgcgtgcatttacagacggccctcctgtgccaggtgctgccgaagaggccgtccttcactcagcctttgcccagcagctatcattattcctattttaaaggtgaggaaactgaggttctgagagattaagaaacccaaataaggagtggtggggtcaggtcctaccagccacctgccatcagctagtcactaagtagaggtctgcagtaggcatcattgcccctgctatttacaggtggggtgatcagggaagacttcctggagggggaacacttgagctgaatttgattatgcttctttatgcctattcagaaaaggggtgtcagcttttaggaaagctgtaattcaatatgcatattgtcttttttctttctttcttttttttttttttttgagacagagacttgctctgttgcccaggctggagtgcagtggcgtgatctctgctcactgcaacctctgccttccaggttcaggcaattctcatgcctcagctacctgagtagctgggattacagatgtgtgccaccatgtctggctatttttttttcttttgtatttttagtagagatgggatttggccatgttggtcaggctggtctcgaactcctggcaccaagtgatccacctgcctcggcctctcaaagagctgggattacaggcatgagtggcagtgctcggcctttattctttttcagacagagtctcgctctgttgcccaggctggagcgcagtggcgcgatcttggttcactgcaacctctgcctcccaggttcaagtgattcttgtgcctcagcctcccaagtagctaggattacaggtgtgcaccaccatgaatggctaacttttgtatttttagtagagtcagggttttgtgatgttggccaggctggtcttgaactcctagtctcaagtgatctgcctacctcagcctcccaaagtgttgggattacaggcgtgaaccaccgcacccggcccattatctttattttttaacacaaacacacacatggtcaaatcaaatacctcttgcctatcattcccttggcctggcaaacatggactcaggacccaactcaaaggtctctgcctatgggaagcctttcccaaatttgtgaggaagggtggctgtttttgcctttcattcactgattcagtgagtagttgttgagagcctactgggtatcagcccctggagctatcacagtcagctacctgaggatagtcaagcagccccataaaggaacaattaccccctgggacaatggccttgaagcagaggttcctgctgtgcagagaacaaagaacaaggtcccaagaagacacctggaggctgcagaaagcattcctgggaaagtaacctgtgtgctcagaggggaaggtgggcagaagccccaggcctctgtgggatggaggagtgccaggggaaatgagagaggctggaacaggacagcagagggggaggggctccaaccaagcctgggcatggatcatgcaggtctttttaggtcatgttgtcctaaagcaacagggaaccctaaaatttgggtggctgggggaagggagtgtagatatttgcacttcaagaggatcattctgatctcagtgaggccagtgatctgccaaggaagcactgtgtccactgaggcagctgccaggcaggaatggaaagggaggaattcaagagaggctttaggagacaagagttgacttggatgcaagagttgatggatctagccgactgaccacctccccctactacactgagtgctttggagaggcaagtaggaccaggtagtactcgccagggtctcctccttcctaagagtccagcagaggccccatgcagggactatgttttcagtaccttggaatccctaccccaagagcaggggctggcatgccgatggtggtccagagatgctggggggccatgccgccgctgctgctccagtcctcccttggctgccagatgacccccaccatggcagcctccaggaactcaggagacaaatcccaagcagagcaaagcctgggtcttgcaggccagcctctgtgtgcagacagtctctatccagaacacacaggcttcccaggcctagcacttgctgggttccccagctctgggctgaccagacgcatgcacacaccaagtctgccagggtctgttccgggttccatgtgtggtgactgatgtcttgtgatggatagcttctgagggacagtgtgtcctggggtggctccggctctgcagtgggacaggctgggctgagactcctggct

SEQ ID NO: 1367 - DNA, 7702 bp, Homo sapiens
gacatcagattcagtctaggacaggggtggagtcgagggacaaagcccaagtggatgccgggactgtgagcagaaggtggaggagaggtggggatgaggacggacctggaggtggaagccagaaaaggctgcaagcggtggtaacaggggcagaggactcgaggcagtggctttgctttgttttggggggtgtctggtccatgaggtatttttactttcagggactcccctgtctgtggaggctctgtggaaccttcaagggtggcctgaaggctgccgagtgcatggaccagagttggtgaaagggttggcaaatgagcttctgtggcacatgatcttcaagcgtgtgcatccgaggtgtgatccaagcatggaagctggtgttgcagacagaccaacggtggcaccgggattcacacctgcatcaactcttgcctttgagtgtgtgaaggacctctgacttctaaccaagaaaagatggcaaaggtgactaggataccacacacacacacaggcacacatacccatgtacagacacacatacatgtatatacatgacactgtcttgctggcatgaactagagaaattctcctcactgaagaagctactgggcacattaaaaaagcccacagagtcaggaaattcaggtagctttcagccaccagccagcaaaaaaaactgtggccctgagccatgcagccacaaagagatgaattctgccaacagcctgagtgagtttgcaaggggagttttccccagtagagcctccagatgaaatgcagcccacccatctccttgaatgcagccaaccagacccccaggagaggactcaacttagtcacacccagactcctgaccggcaaaaaccgcgagatgagaaatatgtgttatgggaagccaccaaggttgtggtaatttgagatgtagcaataggaagccaatacagtcggggcatatgtgggcttgtgctaggtgtgtggtcaccctgggggttatatgtcagtgggtgtggatttagatggcatgtgcctgaatgtgtttgtgtgtttgagcacgtgtctgggtgtgtggatgtttgggaatgtgtgtgtgtgatagtgtgtgttggagtggccaaggggtgcgaatgggtgtgccgattattgacacatgtacagtgtacacgtctatgcatgagcaagtgtgtgcacacacacgtgtgtgcagtgcccctactcccccatcctcttttatgacttcctccctgggtttgatgttgtgggtgaataaaatttaaagagctctaaattttttttaaagagccctaaagggagtggagctttttgtgcgtgagtcattaccaggaacacctgtgaactgttggttttaattgggccacagctgtcaggttgcagagggggagggatgggtctctcggcttgtctgtctcgagcccccacctcctgttggatctttgggtaggtggcaggggcaggaggcaggatggcccctggaaccaggatggactttggtgtccctgggaagcagtggagagttgctgggcctgggtctagcctcagctgctccggctttggcttcatgctcaccacagggctcaggtcttccacccttctgtgtctgacttccctgtcccaggaatcaccaccctgagactgggcactcgcactcctgcaagggggttcgacacacacatgctcatctatgcaggctcacacatcagtaacgacaatggcaaatactcatggagcgcttaccccatgtcaggcactgttccaagtgctctacacacacccaccatcgcattgaatgcttgcaacactctctgaggtgggtactcacgatcccccttttaccaatgaggaaactgaggcacagaggagttaagtaacttgtccaaggtctcacagttagtaatgcatagtcacaggtgcactaacacacacacacacacagagacttgtatactcccgcaccctccaagtatagcctacacacacgcaaaatgacacctgcaaatgagtgacctcaagcacataggtgtatccaccacccacgtgtaagcacacctggcccactcaccctcccataaacacatcacatccccccttgaacaacctcacaatacacacccagcactctcactaaccacaaacatggtgttgcgtgggtgcccacacacaatagcaatcacagaacccctctcaggctggcagtcttacctttctcacaacacagatctgtctataccccccacagaaatgcacacccacacacagacctgcactccccgcaggtcttcatatcccccatctttacacctctcagacctgcacaccatgccagccaccgcctgagggcagggagtttacttctttgtggtctcggggtgtacagcaccaatacccacagtgagtaagattttgtcactctcacacctgctggtctgcaagggctggatgagtaggtgcctctcagggccccaggagacggcagaaccctgtccatcgtccacaccagtccagtctattgtctatgtccacacctgtgagataggacattttttccactgtcacatacgtgacccatggcatgacacagggacctggcgtatgcaggccctggctgaaatgtcaccccttttcctcttctactcaagaaaccaaacagatagcaagtaagtaatgatgtcatcacagaggtgaccctaaatcatctggcatgtgacattattagtactgcccataggccctcaaggccttcatgatttgggggtcaccattaccctcaatatctaaagacactgcacccctggcccatgaacagcaggacctagcctcccttctgcttctgccccgacattggccctgcccctcgaggtcaccttctcactttacttcgctctatttagagaagggggttgcctcgagcccaaattgcacccatttctcccatggcttcaagtcttactacccagctccctcccaagccaccactccccaggctgctgggcacagcctggcaccctgcatggccatctctcttccttcatgccccattaaacaactcgctcaaggctgctgagtgtaacaggcgaagaaggaaacagtgaggaacccctgagccgagcagggagcaactctgcatggaagtcagccccggtccctccggaacacacatcagaccctctcaccatggagcactcacccactgcctctacgtagcctccttggctgcagtgggtctccctctgggtctttctcctcttccacagtgcccatgagcagctctaaattcccattatgggtagggccatttgactcttagctgtctgaactcctcccggtcctgcccagaggcactgcctgaccaaacaggcccatgggggagttttccttgataaagatgcagtgtttccccaggaagggtgtctgcaccctcccaggccagccagctcccagctgcggccttctctcctagaggtactttcccctctctcattacattattacaaatggcctgccacatgccacacactgatcacgatgtagttaaggaatgctgatcaaggtcacctgcctgaggccatccctgtgaggtgggggagaaactgggatgtgaacccacacccctacccacaggaagggcaaacaagtctgcgcccagtgagagacccatctgattacagaaggaaaattaatgctgacaattacatcacggctgctgtcataaagagaagggctcttctctccctctcctccgatgatctcctccgatgatcaactccattcacttgttcaacaaactctcagagactcctcctctgtgccaggaaaaggggacagagaagaatcaaagcagggagccagtgggcaagtgacacacggccattataacatagtgagagtcatgcagtgatggagagagaagggggtgtgggcaccagatgtatacagaggaaaaagccaggaaggctccccaggggaggcatgtaggctgtgcagggagtaacagttcatccagaagatttatgcaaagtgcctggcactgccttaaagcctttcttcctgctccgctcaagaaatcacatagaagccaggaagggtgtggtcctagccactcagggggccaaggagggagaatcgcttgagcccagttcaaggctgcagtgagctgtgatcatgctactgcactccagcccaggcaacagggccagacccttgcctaagaaggaagggaagggaagggaagggaagggaagggaagggaagggaagggaagggaagggaatggaagggaagggaagggaaggtgggggagagagagagagaaaggaaggaaggaaggaagagagggagagagagaaaggaagaaaggaaggaagggaaaggaataaagaaagagagagagagaaagaagggaagaaagaaaagaaagaaagaggaaggaaggaatgaaggaaggcgaagaagaaagaaggaaagaaagagaaagaaagaaagaaacaagaaagaaagaaaaagaaatcacagaaagggcaagaaaggacaagtgggagggaaactcaagctttggcacaaatgtctccgggtcgcttgcaagttccaggctgatgtgtctaaaggcaaagtgaacctttcctgccttggtgccacagcaccgcagcctcccacagccaactttgaattaatcagcgtccccaaatctgcttgtcctgcgggtcttccatttccacaaaacgtgttgtggaggtcatgcctgagtgactctctgattggtgaatttgggaagaatacactgagctcggcactgcccacggggagagggaattcccctttgctcctttacgccatgggagtttcctgggcaggatcccaggggggtacatgtgtcccctgctggggttcagcaatgggcccacttgcctctcatccaaacctgtgtcctacccctggcctggatcaagaactaaggtgacattggctttcataagtcttggttttgtttcttaaattgatcaggactcagaggggcaagagagtgatttttcttggagtttctcaaggacaccaacaaaaggccccgccatccacccttcccttcaataagacctcttgcctcctccctcccctccatgcccacgtttaccaatgcctggcagtgccacctcacctctgttctcagctttaaccacttccctcattgccacactccttctcttgtccgggtgctgccagcttccaggcagacacagcctccccactgttccccttgcttcctgcatccctgccccttgtcccctgctctcctggcaggtgacaggggctcagggaggtctgcctcactcaccacttgaagaagcagccacattctattccaaggggaacatgcctcatttctccccctcctttttttctcactttctctctggacaaggagtctatttttattttatttcatggaatttgtcttttgaaataattaaccaccttcttgaagcaatttttcttcaaccaggaatgcaaaatcacataacacattggaatattttttaacactgctttaaattatgcagttgctgtattgtgataaatatgtagatgggggaagttgggaggatgtgtcctggacttgaagctgggctcccctcattccagttcacagaggaggatggctgggggaagggtggggcccagccaagctccccagtggccaaaagcaagagccatcctggggttttccttcctgcacaaatcccagaggcccagaatacagctgagccagcccctgcttccttcactgggcaggtgctttaggtgccctaccctatgctcccaataaactcgcaacataggaattaggactccaagtttacagatgtgcaaactgaggctcaaagtggccaagaaatttgcccagggtactttggctaggaagtgggttctcaaccccacccagctactcagaaagcttcctggccaagatgactcttctgtgactcccagatgactattgtatacctttatttttctcttcagatgtctctctcttctcctcctcatgctcaggtggtaatcttatctttttttttttttttttttttttgaggcagagtctcatgctgtcacccaggctgaagtccggtgacacaatcatagctcactgcagcctcgacctcttgggctcgagctattctcccgccttggcctctggagtaactgggactacaagcacacaccaccatgcccagttactttttaaaatttttttgtagagacaggatctccctatgttgctcaggctggtctcaccctcctgggctcaggcaattctcctgcctcagccttccaaagtgctggaattacaggcctgagccactgcacctggcctcatcttacttcactgagaacataaatgtttaacaactggttgaggctgggcacagtgactcacgcctgcaatcccagcactttaggaggccaaggtgggaggatcgcttgagcccaggagtttaaattaagaccagcccaggcaacatggcaaaaccccatctctacaaaaaatacaaaaattagctgggcatagtggcacacacctgtagtgtgtggattgggaggattgattgagcctggggaggcaaggctgcagtaagccatgatcatgccactgcattccagcctgggtgacagagggagaccctgtctcaaacaaacaaacaaacaaaacaacaggctcactggattaaaaggccctgatctgtagcatttgccactttccatggtgtaaatgttcccaccatagcctgactcaagctgccaatggtttcattactagctaacataagtcctgaaaatttggccatttgttttcctttctttctttctttcttttttttttttttttttttttaaatggagtctcactctgtctgacccaggctggaatgcagtgttgtgatctcggctcactgcaacttccgcttcctgggtccaagccattctcctgtctcagcctcctgagtagctgggattacaggcatgtgccactgcacccagctaattttgtgtttttagtagagacacggtttcaccatgttggccaggctggtcttgaactcctgacctcagatgatccacccgcctcggcctcccaaagtgctgggattataggcatgagccactgtgcctggctgccatttgctcttctgagacagcccgtgcacaccattgggccctcaagcctttctgcatcagtggatccacctgttcactacctttcctgctcaaggcgtgggaatgccccaaaactctcctcttatccagcaagaatttgctgtctgcaatgatctcctctccttcctgaaccatcactttctccctccactagatgcctcccatcatcatacaaacatgccatgatgtcctctggaagaaagccttcccgtgaccccacatccccctccaggggccacctatttatttgatctccttttcagcaaaaattcttctcctttttttttttttttttttcaaacagagtcttgctctgtctcccaggctggagtgcagtggcatgatctcggctcactgcaacctccaccacccggggttcaagcaattctctttcctcagcctcctgagtaggtggaattacaggcatgtgccaccacactcggctaattttttttttttatttttagtagag

SEQ ID NO: 1368 - DNA, 1761 bp, Homo sapiens
tgatgcattttacggtcacagtgtctgaaaattacctgtggcagtgctttatctttcttagtggtacaaagaatgaagcgtcttacactttatggcactttacattcaataaaacagaagcgatttggtgagtgtcacccttccccaccgtgcacacctccttcccatccctgaaggaacttttaagcccactcgggccccattctgaaaaccccacttgactggaaagaagcagcagcagcagtcggctacagactcacactacttagcagaaaaatgaaatttaactcacatgcaaagataaaaggggacagctctccgcaactgagacacaacatacgggaccagaatccaaacaagtcctttcttcaaagcttctaacccgaactttggagaaagtctggtatctcagagagggcaagaggaacagatcaccctcagaaagactctggtggagcactacagaccagcctgggggcttagtgaaagggaggccagcttcaagtttcaacagtaatttgtgcataatgatcctctcaggttgacacaagataaattaaataaattaatcaaagtacaaattgtgctggcaagctctagtgcctagcttctcctaagaccaacctgccagcaatgccaaggctgcgcctcacagccaccagctcagagctggcaggtgatggggccgagagatgcagtcatgctctgagccagaggcagcaatctgaggggcgggccgagggagggctctgctgagccgcgacagtggaagccttaaacacaagatccattacagcctcaacacccacagccatttgtacatcatggctggaaataaatcctcgggaaagcagccattaatgcgccttgcccaaaacccagctgaagatccctgtctgctgatttgtgatacagggacatacgacttccctcaacttcctcgcttggtattaccagtctgaatggcagcttaggtgactgttgatatatttagtaccaatgctcactaataaatttcattatcatactcctcagagctaacactgagggagccctgagctaagttctttaccagggttagctcactgagtcttcacagacatcctagaaggtaggaaccatgattctctccatttaaagatgtggaaactaagactcaggggaggtcaagcaacctacccaaggacacagtaaagaaactgcagagcttggacttgatctagttacctaatgctgctgggaagttggtttcaaggtagaaaaacagaaacaaattaacaaaaattcagtttccattttttttgtagaagaatcactgattagcataggtatgacccccatgcgtagagattaatgggagaatgaggaaatgggtggccccctgttttgggggaggcagtgacacaccatcttgtcgaaatgcagacacgtcaccactggcagacagacacagtggaagaagatgagtgttcacaaaaagctgtagacacaagcttgacctctttggctgccagctccatgtacacctgtaagatacagatatccctgtcataaggcaaatttgatgtaggccaactctcaaaggcctttctcatcagttggacaaatgtgcagagagacggcaaaatttactactccccctcccacccgactgtgaccactgcacggtcccacatgatggctccatttctatagaagcttccttcaagggccgccctttccaagcttctacaggaaaccctttacggtccccaccaagca

SEQ ID NO: 1369 - DNA, 2673 bp, Homo sapiens
aagggggtaaatcgagggatgcctccaggcctccctcctgggtgggcaagcagatcacatggcccagccctaaaactgttccatctgcccagctgtccccagtcccacctcataccctccatgtgtaagcaccttcgttcccccagcacccacccacctactcaagagccctcctgaggcccccactgctctccggcaaacggcctgtggttcagccaacacgtgcctagagcttttctgatcctccctgaggaagactttcctgagtctgtctgaggaagcttcctgccagagctttcctctctggtgctgtggacagctgttgtccacactggctctgtgccctgactctaggtctttgtcacccgactcagtgcagcctgtgggagccaagtggctcctccaagccatcctcagcccctgccctgcccctgcattgtgcctgcctgggggttctgcatgcaaggctgtagctttgtccccaagaaggagagctctgtccacacttggcgccggggcaagcaggcagggccatgatggagcagcctttggagccccacccagctgtgctggctgactccaaggttctgggcatggagagaccaagggaggcctcagggtgggggcagaagggccagatgagctgaggagggtccaggagatgcccagagcactgcaccttggagggcccagggcagagacacctgtttgtttgccctggccttgcctcttggcttcttcctgagattcttggccctttggggcctggagtgggctgatggcacccctggggagggcagccctccagtgccctgggcggagctcttccttcttgtaaatcacctgcctgctctgccctcactgctatccccaacgccccccaacgcctgccctgtgggagaggaattccttggcctctcacaccgccattcatgctggtctgcagggatgccattctccgggaagccgtttactcctgttgtgctgcacacacatgctgtgcaaagccctgggactaggactggacgtggcaagtggggctttgccagcattcggggccagagtcaggctcatgtctccagcccggcttgcatccacaccccactagctattaggctgaggactctggatttggggccatgatgctaggggcagggctgtatggccctccctagagaagaggctgccctgccacaggttgcaggcttgggcaaggacaggcagaccctggggaggagctcctgtctctagctggacagtgctcctggggctccacttggccagctccttgctccccacgctcaaaatattccaggcacacttgagatgcatttcctccttggggcctcttcagttcttagagcctgggtctctgggcagcactggctggggccagaggactgtggtgcagacacgagctcgtctccagctgttctgtccctgaaaactggcaacaggctgtccacctgagagggagacggagcagagctgcaggacactgccccagcccactctgaagtgtagcagcctcagcctgcagccctgggaagtcccatctgttcctgtccttccagcagcaggagctgccttgcgcagagatgggctctgccttttagtgacatcgagcatctctcccaggcctcatgctgggtggtgagaggcagaagcctcactggacctgagctaaaaccaggatgtcacctgtaggggcccccactgggagctgggccccagagaggcaccctggaccacctactccttgtccagatgatcgaagtggtgggaggagaagatgggggtgggcagagcaatgagcacagggacctcttctgtctgtggctgctgctcctcctccccagccaaggctacactcctacattcagccacaggcaggggtccctcagggtgaggaggtggctgtgctttcagagggatcaaggctccagtctttacctggagttctacttttctgcagccaggagggtcctcagctagatttgtggggcggggagtccaggggagagtgtgaatgctggcaaaactcccacccgccccacctcactcaggcctaggcacctgcaggcaccaccactgggatgcccagcccagcatccagggaccccatcattgcgtagtcttggggtggggggtgaccccagcaggcctggccctgaccggccctgcttgtccctagcgcctggttcgcatgaacatgcccatctccaacgaggacatgactgttcacttcacgtccacgctgatggccctcatccggacggcactggagatcaagctggccccaggtgagcaaggcagcctcggaaggagggccctggacccagggatgtgcacctccgccctcagtgtcagccccaggaggacacgcagggaggagggtgaggggccagctgtgtctggaggggtctgaggacagctgcacaggatacccaccctggggcactggctttttcgcctggtaaccgtctgcacattagcactgcaatgatcccattttcaggtaaggaaactgaggcatggtgagatttcataaattgcccaggtaattcagagccagctggtggtggaaccaggacacagcctggtcaagcctcaccacagccagcgccctccctggggacgagcctgcatgcccttggccccctcccatagtga

SEQ ID NO: 1370 - DNA, 1476 bp, Homo sapiens
aaccacactgctcacaatgactatggactcgaaactgcattttcaggataactgtgttctggactgtatactctcatgaaaacacaagctcgcttagcaacaaccagagtagttggaggaagaatgtgaaaagatggcagaattcatctacaattcctccgatacacaagagtaattagccagttttcaaaatttgtaagtatcacccctctgaaatgctggatgaggaaggcaatgatcccaagctttttctgtttctctctgcctgcactggcttgtctattcttccctatttggtaaaagccaagatgtctcaaattgcagctctcttcctgaaccatccagcctggagtatccccttccctgggccaaactattttcgagtgcctaagggctactcccctaattcactgtctgcaatccttagttatctttttcctataattctgtttaaatggcttaacttgattaagagttccttgaagacagggactacatgatgtgtctttgcatctttcgtttatctaaaatgtctccaacttcagctgaaactgaaagtagaaacccaaagctttcaacagtgttgaaacatcttctcccgcccctatatgcttcaagaactgctgagtaaattaaagtgcacatctgagaaggcagctccatttctccatgtccagcagagctagctagtcaaggtcgatagcaggaaagaaaaaacattgtgataaacactattaaatgtccaggctgaaatctgccgctaaagcaaagcaaagctttccaattacaaacttactttgaactcctattttcatttccgacatgtaattattactaaataaaccaggccgagtgaattaatacttttttggaatatagtcaagaaaaactataagtacaatattttcagtaaattatttacaagaatgggaaagggaggtgtcaagcattttgctctagtataatgtattggaaaattagttacagtgtctattagattcaaatatgaagaagattacatgtatacatatagatatggatatatgcatatatacatgtgtatctacacacacgtgtgtatgtgcttgttcatttcggatcaagtttaccatttgggtataattacttgagtttgggcagtggtctctcgtctcaccttcagctgtaagtactgaacatggagccctgtgaggaattccatttgggctttctacagttgaacctctcacccctgtagttttacaaagtgtcaggtaattttaatatttggagccgtctctgccctcacactcttagatcacatccctcccttacagacagcaaggggtccatcccaccctctggttggtttcatccctccgtgtcccgtggcctcaaagtcacagccaggggaagtacagtgggcagtgggcccagcctgcatgtgacctccgtgtctccatgtccccctgtgcagcccagggtggtaccttctct

SEQ ID NO: 1371 - DNA, 2055 bp, Homo sapiens
gtatagggctttgcagataatgaagcatttccaattccacttgagatttttttttttttttggccagtgctattatttatttatataacctcatgcatttatcagaagaggcttttgaatgttcttaccacataggattttatcctcacaatcatcctgggtggtaagcaggcccatgagaaaaataacaagaacatgaaaccagttccaaaagaattgcctcatgccataaggcaggttctcacacttgagcttccaatcagaatgcccccgagggcttgttaaaacacaaattgttgggactcagccccaaagttcctgatgcagtaggtctgggctggggctcaataatttgtatttatcacaaatacccaggtcaaaaacgtcggtctggggaccatactttgaaaaccactgctattgtgacatggccctgccccagtctaatgatataatgagtttaggcttttttttgtttctctgacctggcagactcctcacactgttagagctgctttgacgagctacgtctgttcacttatttgggttgttatcacttttattctttgcacagcttttatccatctgctagtttgataataaactgaagtgagaacaacttaagccaagttcaagttgacattctccctgtctttgcttctgactgtggtgtgcccagattgtagactggccaggctcactgggtagatattttaaatcctcacttgtatattcacaaactgagcattggaaaaagaaaaagaaaataacttgctcaagtcacagagctagggagaggtggaaccaggatatgaatctaagatttctaacttcagttttggttctaagaatattccagggtttgtgaaagtgttctgaggtttatgatttttaaaaaataatagtggaatctgttttcatttcaactgtaaaagcctccaagtgttgactggctgtttggggcagtcaagatcctatgcctgttagtagcaggcctgttccagcatcatctgcttggttcttttgtcactcaggtgatggcctcatctgctatgggggttttgaccattctacagctttcaattatttttattcaattgtctaacttattctcgcagtggattattgggttcagaaaggaggcatcaaaaatactgattttaaagtagaatgagctactgaactgtacacttaaaatggttaagatggtaaaaaaaaaatagaatgagctgatgagggacataaaaattataattctgaattttgaccttacacctgtaaggaacattcatattatcatttcttactacatcaatatatctctagttcttcaaaataaaagttaaaaggataaaaaggaatatgcactatatggatagtggatatggattaaaagattttatatggataaaaagtttttatccaacttggcttttcctttattgagaataaaattatccatttccacagcatattacttctgaagaagtgcttgcaaatagctgccaaaaagtgcttgtgtctcctcttttagaaacaaaatacaaaaattataataataaaggaatgtattttttaaagtgcaaaagtcaagaattccaaataacaggccatggaagcagtctggatggattcaacacacagttaaatttcaatctacttattaatacacatttgatccccaaacatgatattaatatgtcattttgaatttgtagataaaccatgttcttgcttgtatactttaaaaaagtattcgctatgactttttttgaattgtttttatttttattgataaataatagatgtacatattttggggtacatgtgataacttgatatattcatataatgtgtaaaaatcaaatcagagtaattgggatatccatcacctcaaatatttatcgtctgtttattctaggacgaatttattttcgtctagctatttgaaatgtgcaatagattattgttaactatagtcactctactgatttatcaaactctaggtcttgtttcttctaagcgtatgtttgtacccattaattgatctctctt

SEQ ID NO: 1372 - DNA, 1940 bp, Homo sapiens
caatataacaataaaatgaggctatcatggtacagagatgttaaagaattttcctggggcgcagtggcagtggtagtctaatccagagcttcaagccatttaaagctcattcacgtttgtatttgtttatgaagttcagatgttgctcactagggcttcaccccatagggcctgatggtgcttccattgagacacccactctctcaacaggaaggaccagctggcctctcttctgttaccggggccactcccatggcttaggaatcgctttgactgttggcccctccttgagctccttaagggttttgtctgcacctggggcatccgagaagccccagtcccagcccaggggatccctcagaggcccctgaatgagtgattctggaagtgcagattcagctctggtttagaaggtaaagggatctgggagttgggttgccagtatggagaacgaattcaaagaaggatccagaaaggtattcattgttattattattacatttgaacaacgtttacaagctcagagaggactttcccttagtctattttacatgtattattcactatttcataagtgaggaagttgagtaaaaagtagtttaagggccgggcgcggtggctcatgactgtaatcccagcaatttaggaggtcaaggcgggcagatcacgaggtcaagagatcgagaccgtcctggccaacatggtgaaacctcgtctctactaaaaatacaaaatttagtggggcctggtagcacctgcctgtagtcccagctacttgggaggctgaggcaggggaatcacttgaaccggggaggaggggaggaggagattgcagtgagccgatatcgcgccactgcactctagcctggtgacagagcgagactttgtcaaaaaaaaaaaaaagtagcttaatattgttggtcagtgacatatctcaatgcaaccagaattggtatgggcaccacctcactgaattccacattcaatgttggtgcctcggtagggtggtatgccatatctgttactgctttctttgctgcctagataaatttcagcaaaccatttctttccctctcccttccctgtattcatctccccacaccatctttcccagcagtgttttgtcccctctctatgtttttacatttactctctgagcagctgtctacaagcttatatgggatcccttgtattttatagaagttcttccttttttagacgttgtgaattcttagaatgctgtttttctccaaatcttctgtgtaccgcactctcaatcacatggagatttctgctgtttgcacgaatgtcagtcttaaaaaagtgtgaagataagcattctaatcctggaaaccccattcatttaggccattccttttgcttctaatctcccaggtttctcttatttaggcaagtgtaactctcccagcattgttgagaacattgattaaggtaatgcatgtgaagatgctttgtaagctctaaagcactatagaaatgtcactgattctgtttatctgtgaccttcacattataaagatcatgcccaagaagccagcagaggaaggaaatgattcgaagggagtgtcagaagcatctggcccacagaacgatgggaaacagctgcgccgccccgggaaaagcaaatacttctgagaagattaataagagatctggtaagaggaatcaatttgggaacaactcctctggcttttctggctatgttcaggtgtgtggactgggtgtgtggcatggatcccagacaagtctgggtccaggctgggctgaggagctcgcccagctccagatgagatgttagacatgacttccagagacacagactggagttgtcacccatataaaaaaccacgtgacttggggcaagtctttcaaattttctcagctccagactcctagtccataagatggaaataaagaat

SEQ ID NO: 1373 - DNA, 1752 bp, Homo sapiens
ttctctaaacatttgattcagtctcttctacttctccgacatggctcctttcccctcaccctttcacagctcaacctggagggaagtcataaagaatacaacagagaaatgtgggggatgttctcaagccgggctattacaaaatatttgcacagggtcagcaacgctggcatttacaaggagacattttaagaaaagttttaccaagtcctaaatatgtatttttttttctctcagaaattctatgaagcaaaattcgttgacttggccacaggcaataaagcctaattagttctgtaaggttgtttaatgtttaagcctaactatcattggacagccctacagacccaaagaaatattctcaattcaaagcctcaatgcagagggacaaaagctaaacacaagatggaaagaaatcaatttctctttaacctgggcaccaggggaaaacaaaaacctgacaagggaaaagagaaatttgttacagggcttccaagactttacagggctctggggaactaaccaaagatcttgcgtaggtctaataaaacatctaaatttttctttctgggtgctcaggtcactttacagatattattttcctcattctccccacagcctggtaaagcaggagaggcacgtatttttatacccgtaaaccctaatatagtcttagaggctttgccctcctgtcagtctgaaaggtttcactactgagttatagatacatatatacttattacttaaacagagttgaaatgctgcctctaattcaatttcttcatcaaagctcagatccacagaacaatgatcaactttgcattcattttccaacatcagccacctcatttgaatgacactattttaatgacaataaatgttgcatgggcaccatgaagtgagaaacatcaccctgcattaatacgccatctgcctgccatctccctaagatcccaaggcatgtttcaaagtgagcataggagaatttaccctaattaaaaccacagggggaatggaacgtcagaggcagaatttactttctttctacgaattagagtatttttgaggcatcagactagtctgtctaccagacttgctgagaaggaaaggatggagagagagagaatatgtatgtatagaaaaagaaatgggcaaggatggggagctagacagtagtttttaaaaataaggatactgacttaggtcttaaggaattaaagtactagaaaatagactgatttctgtccctataattttgtttcctcctacatgcctacaccctatgactgctcttccagtagaatcagaaaatatattttaaaaagctttggaagaagtgacaccaaacagttaaaggatgaagaaacaagagtctaagtaatccataaagcagactacttcagataacagaaaattgaaggtatcttaaattatcattcaagaagctaaggtacaaggaggaaaatgaccttgttttgtttccttctagtttactgtctatctttgccacctgcttcttagttctcatgctgcagagcaaatggagagctgaaaatctaaaagagttttcttgtttttcatcctcaccttttttaaagactcaaagggttcctctgatgagggaggtaagtcctgtacagactgtctcatgcgtggccttaaagtcacagctaaacaagccattttattttgtgtgcaatgtaaaaattgttatatttaatcttgtttcctcaacaaacataggagagaaag

SEQ ID NO: 1374 - DNA, 1736 bp, Homo sapiens
gacccttacagaaagagtgtgatgacccctgtgctataagaaaaatagtaaacttaggagttataaggattttctactgggtagtgtctccgtatgttcaggctgctgtaacaacatatggtagactgggtaagttgtaaacagcagaaatttattgctcacagtttcagagtctgggaagtccgatgtcaaggcaccagaagattcagtgtccagtgagggaccattcctcataaatagtgccttctgtgtgttctcacatggtgggagggtgaaaggagggtctaaaaaactcccccagagcttcttttataaaggcactaattccatttgtcagggaaaagccctcataacctaatcaccccctaaagtccccaactgttaatatcatcaccatgggagttaagattcaacatacaaatttagggaggacacaaacattcagaatatagtaggtaggtaggagaattaaggctagaattaggtcctttaacactgatccaatgcactctgcagtatgcctacagtgtcttcaacactaatggcaagtgtttttttttttttttttttttttttttttggtgctgatactaaacttagaacatagttctgttaaatagtaaactaccattttccggtttgtataaattagatttgaagttgatatttcccagaacaaacttgttattgtgcagcaagtgggcaaaaaggtgggttttttttccttgtttgtttgttttttgcttccaactaattcacagtggtccaaaatttgtggtttttcaatagccaatttatagcagaatgaccaaacagtgataattgctgccatttattattattttttctttctttctttttttttttttttaaaagcagggtctcgctttgtcacctaagctggagtccagtggtgttaacatagctcactgcaacttctaactactgaactcaaaagatcttcccaactcagcttttcaggtagctgggactacaggtgcatgccaccatgcctggttaatattttaaattttttgtagagacaaggtcttgttatgttgcccagactggtctcaaactcctggcctcaggtgattatcctgcctcagcctcccaaagcactgagattacaggcatgagccaacacacctggcctattttcttctctgtattgcaagtactagaaactttatatacataattatagtgattttaaaatttcctcccctattccttcactacccaaatttctttaaaagcagatctgcatttatctcttgtatatattggccttccccataagcttaaatttgaagaaaagtctttgaagctaaaaaaagaaatacatgtgaaccgtgccattatttcatctattactcataactctcctatgaaatagatagtatgctcattttaaaggtgaaaaaattgttatctgtgaccttaagtctgaaacaaattatggaatttgaactcaattctgtagaccgtacaggttgtattcataataatacatcattttgccaaactgtaggaatgcagttctagagaactcttacaagagttcttaaaatggagaagatgatagaaggatgatattgatattctccaggataagatgagaaaagaagaaatcaaaatatttgctttgatagctcatcattatatttacaaagctctctttgtgggtacatctaacccaggtaattttaattccttattcctgtgggtcacca

SEQ ID NO: 1375 - DNA, 1731 bp, Homo sapiens
ctgtgctctctgtccactggctctggaggtaggtagaatgggcagggaccttctaggtatcctttgaacaatgtcagtaacccccaacttccctcaacaacgatgccccagcagttttcttcctcctacaagaatgagacttattccttgatctatgctagttttatcatctcaagggtcctcttttgtgctgcaaatgtcttgggtagggtaataattcacagtcatgaacatcttcacaggattccataaagggacaaaggaatggcatttgtaagagtagaaggggctcttttgtattactttgcagtctcaccttttcagttgtcactgtttccctcacttcattctctgcaatgtggtcaatacccaagcaagaggccttacctccaaaggatggagaaacataaaaagtgacaatatggaagatgaatataagaaagagaacagaaatacaattaacctctttcttttggtgattgggaccagtaatgacttgaagcctataattaagataactttaaacaaatttttgtgacactcagatccacaaagatttaataggggaacaaagtagcctttggatggttcagtgccctgaggccttggttctcaggggaatcctggtagaatatactagtgaaaggtcactccccacttactaccagtggcctaactgcaatcctgtacacagagtcaaccttaaggcagagatgtagtaaggaaggggatttcaaagggaccctttgtgagtgtccctgatctgcctgtcactaggaggctggagggccaaaggagtaggctgagagattgagtaccagaagtcctagatgcagggatgcttcctccaggtgccactgcagaggtctgatgacctgcctgcttctatagatactgcaacactgttttgtcttccatcatgaaggtcactcagattacacaggtactgcaataagcagttctgagcatcaaagagcctaaaatgaaaagtatgaaatctgttgggaccaggtatgggatggacaaaggtcagtcagaacacatacccagtgaaatgaagtaaaatgaaaggccatgatgatctcaaactatttaatgacatggggaaatgatctcatctgaacagtaaagaataaaaggagtctacaaagccttcaaaacttggtgagggcaatcaaagtccctctatcttaccaccactgaagctcatcacggaccccatactgaaagtacctggactttatgtgcatgaacaatccctgactttatgatgatggagaaggtggttcagggaaggctgcctggcttgattctgtagctgccggcccagaactgagctccttctcttccccgtacacagctgcttttggccctcttgacggttgtaccaccttctttcacttgtccccagtcctcttcatacccactctcttactggtccttaacagatggtcaccaaattcattctgccccctgactctcacttcagtgggtctctcttttccaaccctgaggcagtaccccgattctaatgcctgtcccctttagcccactgcttgcagaggccccgccatagtgcccagctgatcctggaacctatttttctctccctgatgtggctgttgctgtgtcttaggctgctgagagcatattgtcacatgatcaaaaagagaacatttaggatttcacaaccctgaaattatagtaagcctgttaatttgggtcttgggc

SEQ ID NO: 1376 - DNA, 3124 bp, Homo sapiens
gaggacagagagagagactggggcataaagaaggagagaaggagggagggagagggggagaagagagagggaggaggagtggaagagagagagagaaagagaaagagagagaaagagggaggtagagagcaagagagggtagagagaggaggagggagggaaggagagacacatagggagagagagaaggagctagggagagtgggggaaagagggggagggaagaagaaggagaataggagaagtaaaaattaaccagggaaatgaaatcacatttgtttttaaagaagggaagaatagcaacatttttaaagtggatggaattaaacctggaaaatgaaactgaataatattagaagagttggtggggtaggggaaccagaggcccgccgggtaacgccctctagaaggctaagggcttttctggagaagcagggccagcccctccctgctgcctgggaaggtggaactcggggtgctggggaaggctgaggcctggaagtgctgctggtctgggcgatgtctcatctgactactgcaaagggaagcaggaacaccgcagctacgggggaagatgcgctggggctgtagtgagtgcagagacggggtactgggtgaaatgatgggctagggatggcggccctgagtgcacccggaacgtctggcgactgcgcagatccactcggggctgggggggttctcaccgttgcagtaaatggctgtgcattccccccatttttaattacagagaaaggaagtgttactttgcagcagacttgcatctcttcaaaaactcctctattacaggcagcaaaatgccccgccaggcagacagaagtgaaatcccctggcagtgatgcacatgaagctctgggtatcagtagttcacatttaataatatgcccgtcataaaactcataacctaaattcaaaagcctttcaaaaacactcagtaaggtggaatacaagggcagtactaattataaactctggggagttatgtagggagattaacgcacctcagcaaatatgttttcctgagacccagtgcgggctggagctctagtccacggattgtccgaggcctctttattgccgcttcgaggcgcgtgtggtcgggggtttacatattcattaagcagccagctcggagccgcacttcaacaggtcatgagcgcccacggagatgaatcagctactggcaccaaccaccaccacagccatatgcagcggagtttattttattttattttattttatgtgtatttctccagaccacccactaaattttatttctttttccaggctgcgtccctacgcttagttcagaaacaagacacgatattgcactcctgttttcacacttagaacatagtatagggacaggtacggtggctcacgcctataatcccagcactttgggaggccgaggtgggtggatcacctgaggtcagaagttcaagaccagcctggtcaacacggtgaaaccccgtctttactaaaaatacaaaaattagctgggcttggtggcgcgtgcctgtgatcccagctactccagaggctgaggcaggagagttgcttgaacccaggaggcggaggctgcagtgagccaagatcacaccattgtgctccagtctgggcaacaagagagaaacttcgtctcaaaaaaaaaaaaaagtataataacattgatttctgatctgtcttcatttgggattatatgtttagaggccagtgacttgaaaatgggatgggcctgaaagaaggagataatagaattatccaaatggatttgttcaagtctgcaatattggatgagaatgcaaatgtatgcagctgaaaaatgcatctcccttttttccagattaaagcatctttcagtgtgtgagtgctgggtattcttgtgatctttcaccgtgtaagtgctgtgtgttcttgtgagtaggaaactttcactgcacttatctccaggcaacgtttaatattacagttcttacattttcatccactgaggcaggtgtgtgctggttatgtctctgcagatttaatttgcattttttgagggatagtgtgtttgagtacttttatatacacttactgaccacttgaaaacagtcttttgtgcagtactctttatgaatttcccctaaattataatgggttatttatctttgtattgctctgtaaaaatactttgtctattttgaatgctattcattgttgattctaagtgttgaaaaatcttctaggctatggcttgacatttgactttcttaatactgtcttttgataaatggaaatgcttaatgccttggcttctctttataaattgtacctacgctgatgtcatggacatattttattttgttaactttattaacttccacaggtagatttaaagacaacctgttacttacttttctgttacgttttgtgtcagaggtgaagagacccttctttccgtacagcaccacgtgtccatcatttactgctaaaatagtgctgcacagggagccacactgaagcccagtgacttgagagaatgagagcttacccagcgtgccaggcggagggtcagcggttgaggctggacgggcctcaggcgctccagcacctgcttgtgggtcagctgaaatacggcagaagagactagactatgccacttgggtctcattttcttctctgcatctattgatctaaagatatgactatgtcattttatttctagtttgttaattgaaatgtaacaaaatcattttttagcttgaatcatcattgcatcgctacagtaattctaagctggatttgatgcattgctcttaatttttacatttctttctttctttatttttgagacagggtcccactctgttgcccaggcgggagtgcagtggtgcaatcatggttcagtgaagcctcgacctcttgggttcaagtgatcctcccacctcagcctcccatgtagctgggactacaggcatggactacagccatttccaattttttttttcttttttgtagagatggcccaggctgctctcaaactccagagctcaagtgatccgcctaccttggcctctcaaagtgctgggattataggcatgaaccactgtgcctggccaat

SEQ ID NO: 1377 - DNA, 1673 bp, Homo sapiens
actgaacatcagcccaatgacaattatacaatctgagctgatacccatttactggcctggtactgactttctactggtgcacgcacactacatgcaagcaataaaaacacagttgaatctgtctggcctttatagatgaaagtagaaagaaaaaattagaataagttttattttacccataggtttatgaacatttatttctatagccatatcaatcaatgctactgactcaatacatatgcatttcatcagctcctatgatatattagtaatgtttacaggtaaatttttggggggatgtgtgcaaaagtcaatagttttgaacttgaagtaactgacaggttagtagagttgtcacacataaatacgatcacttctttctcaacaccacattgcttaatcctaacatgctagaagcctcgtaaaatatgcacgtcccatttgttcttcccttaaaaatagttttactctgttagaatttggaggctggtaagaattaaccaaaaattcaagaacaaaccttgtctctataggatatggaaaccgcacatgaaaaatgtgttccttccgcttttgtagttattagacatgaaggtgatactagcctttgactgccagagtggtaagccaagttttggccttaggatatcaacagtaattcagtattatctcttctagcatctaattgttcttagctctgtgtttgtacaaacacatgagacctgacaagttcacttgcccttaaactctctaatttctgtcccatatgagaggctgacgtgtttaatattcttgaatttctaccttactttgtatcattctttgttaatggaaacttttgcacctttctaacctgttggctgtgaaagtttaacttttgttagttttaaggacagagtgaaactaaatgatgtaaaatgaaaagataaaaccagagtgtatgtcagttactgagaactctcctcccaccatgccttttgtcctcctccaaggtgctggcctctgtgaagaggttccagcctttatttgaacccccagagctctggaccagcagctgggatatgtcatgattactttagagtgagattaatttgagggcatcatgcaataatgaggtttgcctgaaaaattaacacatcttaaaagactgagagcaagtttgcccctccttattctttttttttttttttttttttttgagatgggagtcttactctgttgccaggctggagtacagtggcacgatcttggctcactgcaacctctgccacccgggttcaagtgattctcctgcctcagcctcccaagtagctgagatttcagcacatgccaccacacccagctaatgtttgtatttttaatagagacggggtttcaccatgttggcaaggatggtgtcgatctcctgactttgtgatacacctgccttgacctcccaaagtgctgggattataggcatgagccactgcacccagcccaagagttagtgatatctttttttgtatcttctccatccccatcctctcaagaagaatcgatttgtagatatcttttcccttgccaataggtataattccattctgttacattcctcctttattaaattgaaatcagctaaggaaatgcaattagactttaagaaatgtaattagaaagagaaatattctacaaag

SEQ ID NO: 1378 - DNA, 2724 bp, Homo sapiens
tgtccccagtttaatgagggagttactttgctctcaccgtctccactttgcccttgtgtgttcatccgcagctcctgcagcaggccacctcctccagcaacctgggtgcgttcagcggcattcaacaaatggcaggtaagtcaggaagcacgcctctccttttgaccgtgctattgtcagaatttggggttggttccgagggcaaagacaagaagcaggggaagagaaccaagaatgatgatcagacttgttagctttctgtctttggtgttaacgttggaaccgcctgctctgaagtgtctctgttatttcttaggttacctacccaccttcgctgtgcatgaccgctatagaatgaaggggctgagaaatcctgattggcatctatatcaacaaatgattatatcaacgactctctagtcatttgttgtttttataaataagattgattactgggggctttccatccagattcctatatctagggcagccaaatgattgacagccctctaaaattttaataatagacagtcaataaaaatgttctgacctccgtaatgaaagccaggattgcaggcctatctttgatgcagtttgcagccccttgataacgacagacaattaacagggtgcctttttaccgtagtgccccagttgacagaatcatgcatcagaagcttttatgtgaaagtggaatctttgttctggagaaaatcaaagtgtgactgtatttgaaagccagctcgttgaaggattccttcttctaatgagctgcgccagtagtaactgaggtgtggtgattagcgaaaggtcactcctgccgtgccaccttccgtgccgatttccctacctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgcaatgaaacctacatgtgcagaatgaagcgttttttcgttgtcatcatgaaaactcctttttttctacctttctgtttctttttttaaatatgtatccttggggtttgtttattttttttttcttgtttcacttcaaatgaatctggaaaaactttccagggggcttctccctgggtgtggtgtgtgatcggcagccccgccgttgtggcccgaggctcctggaagctcatcagctgatggtcttccttggcctgtagtaaaaatactgctgaattcctcgttgggctttaaatccattggcactgccacctggttccgttgtaacatagcttttggattattagaaataggaataacttgatagttaaatcattcagcagcatctttacgaatatggtttgggaagctggccttggagctaagaatcacattgaatggttaatttatttttaattctatgaaaggagctggagagagagaagtaaaatattcaggggattttctgtgttttaaaagagaaaacctcctgattgcaagctctaaaataaatgctaagatttgtcacactttcagcccacgggagatttgcttttctcgcatagtatggactcaccaggatctgaaattaggggctttccttagaggtggcctcaggctttcctacccccacagttggattatgcagagaaggtcactgggtcctgaggctgctgccgagcgtgctgtcccgggtggacagcgtgccctgtcatctttcattaggatgtgtgtgcctgtgccgcaccagccacaggtcaggatgccagcccctgcacgctctgcgtgctcatttgaaaactgagggtatctgggaagtcaccttacaaggtgccgaggagcagatggctaatttaaaggcaatctgtatgtgctctgagcctcccaaattatccatttcttgaatcctcaatgtgtgaaattcagcacactaagtcctcacaggctaggaaatcaaatgctggacaggccattccctaccatcatctggagtattcagagtatttggaatattcacagtcttcaaggtgtagctgtcgggctctgtgaaggataccttgcatttatagggatcgtcaggtctcctcttcctacgtatttgaagtattatggcttggagtactttctccaccaatgaagaaaagtttatatggcctctcctacgctcttgtcttgtcccaaaagtagggcttaactctgtccttgccatcaatctgtgcacatgttatggagtgaccatggtgaatgggcgatagaggttccttcctaggagaaactttcccagcttccccgaatgtgagaggggcgcctctctcccgaattccccagagccctttcctcccttccctctgccctcacctccctggatgcttcaggatactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttg

SEQ ID NO: 1379 - DNA, 2730 bp, Homo sapiens
ttgtagccttcctgactttaaatccttgctttattcagatccttggccagttcttctgtactggtctcctgggccacccatagggctgtcttcacttcctaccatcagctgttccctctatccaaagatgaaggagccctgtatttgctgatgtgagctgcttcctttatttatgctctcactggatctctgggagatgtactctaccatcagaacactcagagacagttacctggacataaagtgttggtgttggcatcgttatcaaacaataacagaaaacacgtcagcaccaactgcatctgtccctgtgcttgataaggaaaaaacaacatgcacagtcctgtctttgaagagctgacattaagatggacgatgccgtgaaacacacgcatttgtaagttgcagacatcctcctatgcaagcactctagtcacatttgtttggtaaaagataatcacttttagcttcagaaagaactcattcatgccttgattttcagtgttgccacgggaaagcaatagcagaacctgggtccctgctgtgaaaatgaaaatacttaaggatgttcaattgcttttctgttattcatgtgcatccgtggtaggacatcatggcagagcagctgctcagagcgtgcgattaggtgtgggttcccacttcagcctgggattgtttcatttcctgcagctgttctccagcatggtaaaattcgaacgatgtcgataattttcccataaggggctctcaagatacatcaggttgtgctctctagagtagtttaaactactatttcttgagtacttactatgtactgggcagcattttccatatctcaggaagcagtctcattttcaaaggaaaatgaaatctgtttcgggtcacaccacttcctgcagattcaggacaccccactgagagatttaaaaaccgtggatgctcttttcagtctgacaagatgcttgtcatagagcatcactgtctgggctacagggatgcagaaaggaccgaaggtctgaagggaggaaaagggctctgtactggtgggtttctggaaaagcctttactttgaggtggtccattgagcttgtgtagcctggaggggtagaagcaaaattaaacgaatacgggtcaaccttttaacgcgtatcttgcaaataacatgctactggctctatgtgcaatgcctggatataacaaatctatttttacgaggcctacaaagaccaaaatatctcgatgtgtgtgatgtgatgtaatctctgcatttggggtgggaggtgagtagggaaacaactactttggaattagcacgaatgtacacaatttctgagtaatgatgcacgagaatgctcaggtattcatagaattcagagagggggtgtgacctgcccatgatttaggaaaggccttaggtgtttctgggaattgtatgttcatatgttcctacagccaataactcgcatataatgatcatcattatttgttgaacagttaggctaactgagtatctttttgggggttacttggagcagtcgctgtgttttcttgagttgtaaaaaattatggtgaaggttttggcttaaagaattggaggtggaagtgattccctgctgcatcttattttgagagtggaagggagaaattctgtccattcagtgaggcgggatgcagctgcgttgtaggttctggtggaataaggtgtctcctggagctggaggggtggtgtggggtggaccaaggaagcatgtggctcactggatcctaggaggtgttgtgacctcatcgtgcccacctggcatcagagagtaggcagtgcactgcctcaaaggagaaaccctctgggatgagacagacataaagtaagaagaaaagagccagtctttggctcagcaatgcatttgtgttggtttctttttgtccccttttagacaaacctattcgtggtagaaagagagcaacgtgaacacgatcaggagagggagaggagcagtcctaccactttggcctttgtgtcctccatgaagagatgctggtgttttctgagcatttgtgagctcttggcatttgggtcatagtgcatcggtattcacaacttttccacacgggccccagaggagggcttgcagcctccccattgccagcttctggggatgagaagaattgcagaattgtataaatcccttatcatcagctagaggattgttaaatgcacacattaaggcaaacaaacaaacaaataaaaaaccaaccaaccttttgtcaacaattggctttattttttaagaaaatacagtagaacgagcaagatgtggtggcgtgttcctgtagtcctggctgcttaggaggctggggcaggaggatcacttgagctcaggagttggaggctgcagtgagctatgattgtgccactgcactccagccttggcagcagagtgggaccttgtctcaaattacgaagagagagggaaggagggtgggaagaaggaaatagcagaacaatagaagtttgtaaaaatacccaagttagaagaaagaaaaaaacaggagagatactcaaggatatttgactccagttccccgcttcttacatgggaagctgggtgggcccccctgtttctagttcagcattccctttgagacctcctcaactcaagggggacttcagaaacaatggaatgaaacaatgggccctacgttttcactcagagctcaagctttatgttgcca

SEQ ID NO: 1380 - DNA, 2498 bp, Homo sapiens
gagcatcacttgagcccaggaggtggtgatcagtctgggcaacatagcaagaccctatttctgagaaaacattttaattatctgggtgttgtggtcccagttacgcaggaggctgaggcaggattgcttgagcccaggagttcaaggctgtagtgggctatgatggtaccactgcactccaacctggttgtcacggtgagattctgtctcttaaaaaacaaaacaaaaccttctgcccagaagtgacacacatcactctgaccttctttcaatggccaaagcatgtcctatggccactctgagtgcagccaggtacttcctgcggggatggaaactagaatatttagtaaatggaaatacagtctactataatgactgtaaaagacagagtgcaggcatcagatgcacacattagcagcaaagaatagtgacagccatccttccagtggaagatggactgtaccttggaatctttcttactccaacattctggacaaccactaccaactggcagaggccagcaactaagataagaagtatctgccaacccttctacagagtcagagagtccaagcttcagggttaagggaagtctttctagaagagctggagactttctggaagaactgccctctgccgtgaggatgggcagttaatgaaccacgcgaggcaggaaagattgtttgaggtagcagcacaggtgaagctctagaggggagatgggtgaaatgagggtcccctggcactctcaatgaggagagatggtgcagtgacagaggagacagaaaaagggaggcagaacaggtgttaaggaggtcaagttgattagacaggattgtgtgggaattaaagaagaagcagtgaaagaggacatttgagttttctgcttgagcggagtctagaggatgctgacattcaggaactaggcaggaggaaggaaggacaggtctgtggggtgacatgaggtcagggctggatatgagcagtgtgagctgctgtggagccacacagggcacagctggatcccaggcctgaagctcaaggtaagagctgaactccaaatatgaacatgagcatcatcagcttagagctagccatggaagtcctggactccaagactgcgttggaacaaagtgactgggacacgcagcatggaggatttccatcagagcttggaggaatgttactggagaaggggagcaagagcacgtagccaaagaggtggggggtgacacgggtgagtgtggcaagagggaagctgagggcagagagaccgagaaggaggagactgacggggagccactgaattcactcaaaaagtggtgtactggtacctggcaaaaagtgggtgaaagcctgggtaaggggggcaggactggaggctgctctcaatgattgataggtgaatgggaagcggggaggcagaggcatccttcactcaccaatgtgcttcaacaacagaatcttctcccttttctccctccttcccctgcccagataaacatcaaatcctcctctgaataaaagtccccattcgagttaaaataagaaacatgaaaacagatgggttttccaaaaacatgtccatagttccaatattcaaaattacccatttgtagcactgtgccttcttttaaatttaaaaatgattacacatcatcttctatagtgtgtcacatatgcagaacgtacaaatggcctctatgttgatgactccccggtttgtatttccagcccagatctctgccccaagtcccagctgtcccattgaacatcctgctcacaactcagaccaaacatggccaaaggcatcttccaggtgcactgtgagctccaggagaatggaaagaatgaaagtcctgtccggttaggccaagagctacggtcttcccagtgaagtgcttgcaaaacagtatttatcaccccaagaaccactgcctactaaaactacacacaaagattcttgctataaacaaagatacatggatatcttctaaatcacaagggcacaagtacagtcagccctccgtatccatgaactcaaccaatcgccaatcaaaatatttgaacaaaagtgtagaaattccttttcttgtcattattccataaacaatacaacaactatttacacagcatttacattgtattaggtattataagtaatctagagtgatttaaagtatacaggaggatgcgtgtaggttatatgaaaacactttgccattttatgtcagggacttgatgttctggaacctacccccacagatattgagggactgtattccctcctttgttttctctctcaattataagaatatatttatacaataaacaaattagtcacacttaacacttttattttggtacttatccaactcactgacctgtgtcacacaacatcacttggagccaaatgccagcctttaggaattaggaagctgaatggccgccctatcgccacctggttttgtcattagccagtttcctcctggctcaga

SEQ ID NO: 1381 - DNA, 1716 bp, Homo sapiens
ctgttatatggagaagaggttgtcatagcatcaggcagtataataagtaggacaaccagttcagtggcaattgaagctgtacaagcaagaataaagatttcggctagaaggttagaagggagaagatgaagactgaggtacatagaggtggagctgagaagacttgcagctaatggctgagatgttattgtatggataatccaaggaaatataaatgggtttgagaaactcagaaaatatatacaaatgtgaggcattgctattaatatagcaaaatgtgtggttcaggatataaaaggctactctttgtagatacatgtgctaaacttactcctgaacataaggtaggaagcgtcacatatatacatttacctaccaggcaactgaggggctctgatgggtcctgtctgagggcaagcaaggaaatcatcagcaatactgactactccaattacttctcactgtagttcgtccaccatggccaggctagagtttctccttttgagacagagctgtccttgtattcctgggcagcatcttgaactcactagtgccatgctgattccatgattagttgccaggaaaagcattcccatcccctacccagtaggctacctaggacattctttttgtttttttgttttttgagataagaacttgctctgtcaccgaggctggatagctcactgcagccttgaagtccttggctcaagtgatcctcccacctcagtctcctgaatagttgggactacaggtgtgcaccaccacacatggttaattttgtttttatttttagaggtgaggtcttgctatgttgcccgggctggtctcaaactcctggactccagtgatcctcccaccctcgcctctcaaagtgctgggattacaagcatgagccaccacacccggcctacttaaagatatttctgacagccttcccacttttacagggcattgagacttgcaaaagatgcatccataaagccaaaatagccgtgcagttttggaagccccaaatcaaaccatttatgtgacattatacagaaaaaattaaatggttcattatctgaattttttttatctttcagctgtaaggatgggtcttatttagacacagccaaaattactgctctataaagagcttagggctaccctgactcggaaagatctatataaaactcagttctatttccaaggctgctacagatccaaaataaaccatcagcagtctgtacattcatttatatatacatactgtaccttctctaactgaaaatatttcacacagcagattgaattcaatatgctttccctgaagatgctattatgaagagcaaaagtgctattacctaaaatttaaacagataagttattaattgcagtgtttttatagcctccgcattctctccactgatgattctcttaacctttccaattacaaaaacgatccaataagtatcctagtttaattagaaaatatgtgctcaaatccttatatttttggcagattgcattcaccactcagaaattaatgtccagggaaagtgtctttccaatatttcaggtgtactctggatcagtaaagatattgatactttctagatattgtaaagcagaaaatagatattagcataaaatgagcaatgtagaatgccttttaaattgaataggtacttttttctgttaaatcaggaaagaccttaaaattatattccc

SEQ ID NO: 1382 - DNA, 2459 bp, Homo sapiens
gcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcaaggggctgctcaaaggccatgccgcccagacgttcagagcagaccctgctcaaaaaagaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttccaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcatagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggcctt

SEQ ID NO: 1383 - DNA, 2239 bp, Homo sapiens
gttcttaaagggtttcaaactgtatttgcactcctttagactggaaagatccatgcagagcatttttacttagctcctgcagtaagcttctactgtatcaggcatgggtggggaacctaaaagctgagggagatgatctttttgctccagaatctaacacattgctgcctttaaagcacttttcagtttccttagaggaaagaaattggttggatccacaatcctaaatagttcaagacagtgataaaggctctcctcacatcgtttaaaattaaatgtttcatatgattttataaattctattttttactcatttcaactttatttgtcccccgctccccagactttccctagtctctgcatattttttaataccacggatgacccccgctgccatgcactgtgagtcgggcagcctcctcatttctgtttcaggacactgggaagtgcaaaggtgcctggactttggggcgtgcccagagcatcaccatctgaggctggagctatctccagagcgggcagctccctctggtttacatgagtgttcagactagattgtgggcttggcatggggtctctcctagcttctttacttcctgcctagattccaagcccaaacttgccaaagatacttttttcctgtcttattttgtttcaccttcatgttgagtggtgtgaatatgtgaatgaaaatgacgaggaaggacatatcagtgctgggaacctaaaacgtgtgctgtgctttgattcgattcctgtaaaacagctcatggtgtgggttgaaaggagatggagatgaaaatcttacttccaagctgcactggacatttcaatttatccttgtaaacaacctctagtggggagccaggttgagaggtgggcatgggggatcctggtggacagctcttggccctggctgtttgtcttattttacttggaaaccttttttttttttttttttttttttgggtgggagaccatctggcttttctgagaagggatccgtctttgtcacactggcatgagctggtgctggaccccctggcaggacagctggtggggtgaatttgctgtggaaccattgggagtaaaagacaaagctgggaatctgaactcccaagaacatggacatccaaacatgtatgtggaaatctgtggtttgtgaaccatcagcacaagtaagaaagggtagaatcgagaggaaagattttctattcacaggtgaaaaagcaaaaataatttcaaactctgtccttggcagctgaattacaatgtggacgtgcccttgtctcttacagagacaggcgtctttaagtagacactgaggctgccccatcccatttgaagctgtaggtcagagagctgcaatgggtggcaatttacatatcctcaggttgtttgtttaaatagtctgttcaacaagtaattaaaatgtcttgcaatgagctcatgatggtttagggtagaattttaggagctggaaatttccatgaaattgggaagaggtgatgactctggctgataaattgaggaatggatggaacttaaagccctggatgtggggcacattctggaggaggctgagctaggaattaggtggcccctggtgtacccaagaccgaggccagaccctagagcacatgcatttaggatgattcctgaaccccaacttcctagtaatgtcccacccttgggcatttcaaagagccctgactcccacagcgcacactggggaaaagtaaggcaactgcaatcttgaatccctgcctgacctgcagctaaggaatgtctttaacacaggcagccaaagagatgtcaccaagagcacctgtcactcactaagagatgagtgatgacaacggacatagaagtaccccaaaaattgagggaagaacatgcatgtttgaaggattccagggacaaagccggggaggggaatcttaccttaacactgcataccctggccaggcagcatatccagcctcaaggccccaatacttgctcaagccaacacaggtagagatgctggggagggacccagatatgataggcaactgtaggtggccctgtgcaagtcattctctttctcttgcctccagagcagccagccctgagcgtggcacaaaattggcacttgggaagacttagctggcataatttttattgttattatcccccttattttttaccagtctcctggctcctgtgttcatgctaactggtcaaggcagagtctaac

SEQ ID NO: 1384 - DNA, 1520 bp, Homo sapiens
gatgctggacttaatacctaggtgttgggatgatacatgcagcaaaccaccatggcacacgtttacctatgtaacaaatctgcacatcctgcacatctatccctgaacttgaagaaaaaaaggtaaaaaaaattcagatcattgcactaatttggtgactctgcttttctctttataagacatgcagattaaagtgtagtcacatgtgttctcccaggtttatgcaaaagaaatgaaaaattttaaatgccaggagccaatcaaaaacaaataagtattcccaggattattaattccatacaaccgaggctcagccagaattcctctctgccatcaattatctcagaaacaccacagctattaaaagctacataaaccaccatctaaaaaagataaagcagaaagttcaacgggaaataattttgaaattgactggagacaccacataaaaatcaaattaaaaatgcagactccattaacttggattctgtgactttccaaactgggtggagtttaagtccacctttcagtcttttccaagaaaaggagactgcacacattagtaaatacaacaggcagagtagatattttaagacaatctacttttttaaattgtatacatttgcttgtaagcaaacagactgcttaatcactaactttcttttccctaagaaggaatctaatctatgcaaaaatccttggtagcaaataataggccactgcttcctgcctcttttcattacctcaccaagcacccatttccaaatttcccaatgaagcaactgcaagttctaatccctctatctaatttgcatgaagctgcggactagctatcctgaagcacagcttttatcagccctacaatacacccttcctgccaaagagagttaacatgccttggactggttttcaaggccaacacctctggctccagccttatcttctactgcccttcctcccagccctctccagcagccagactcctatactatctatcccggaaccttgacttaaaaaggcacactcaccaatctgctaccctggcatgccctgagattgtactaatacacctgcttctctgacccctcctcgtcaacctcctttgacaacttttacctctgcttaaacccttgaactccttggaaaactggctgattctaggtctggggcaagcaaatattcaagatgagcctgagcatcctggaatgccagaaaataaggacgtactaaaacatacacacactgtaagaactcccgaaggccaaagctggaacaacttgaccaaccaaataaataatgtagtattgcattataacctgaagcataaattaaatatccatgaatccatactaaaaaataaatcattgattaaataaatgggagcgaatatgcaaaccttctgtgcagaagaattcaaagtaatttatgtagacattccaaccacaaggagaagcgtaacttctccctactccttttgtgtgggctacatatagtgacttccttccaaagggcacagtatg

SEQ ID NO: 1385 - DNA, 4359 bp, Homo sapiens
ctatggttttgagaaagaggagaaacaacacacattaggctatccttttgtagactgggattcataacagcagcagcaggaggaagtttttctgttcaaattgatgagctttatacggaatgtagtctaaagttgttctcctaaaggtattgggcatatgagttttgtttcaggtcgaaaagattaaaaaattgtcttttcctgtttgctgaggaaatagagatacattggtggtgtaggaaatttcaaactttttctctaaaggttaaagtctaagtcttttgaagtgaattgacaatagagagattaacaggagaaaatgtcatacaggaatagtgtatgggggaggtcatggtgacagaattggaggatggagtcagaaaaaggtgtgtctagagtgctataagtgcagccaagtaatggagagccacttaggacattgcaattaatttagcttttacttagagtgagatagaagtcactggatggctctaggcagagcaatgaacttatttgacttagatttttaacaaaattgttgtggctgctgtgttgaaaaaataaataaagaagctgctacaataatccagggaacaatagtggtgactttgttcactgtgggagaaggagattgaaaaatcatcagattgtgactctctctctctctctctctctgtctatctatctatatgtaatttttttttttttgagacagtgtcttgctctgtcgcccaggctggagtgcaatggcgtgatctcggcttactgcaacctccacctccctggttcaagtcattctcctgactcggcctcctgagtagttgggattacaggtgcctgccaccatgcccggctaatttttttgtatttttagtagagacggggtttcactatgttggtcaggctgatctcaaactcctgacctcgtgatctgcctgcctcggcctcccaaagtgctgggattacaggcatgagccaccacacccagccgattgtgactatattttgaaggtaaaactgaaaagctttaccattgcagtaaacttgtaaaatgagagaaagagaggaatcaaggggaaaccctgaggtttctgttgtaaataattagaaggatggagttgttatgaattgacgtgaagaagactggaagaacagtacactgaggtggagagataagaagctcagggagagaggctggagtaaaatcagaagcttaagtgatctttggcaggtagatggtttcttgtagcattgtttaagtagagggagctattggctatctgaatatcattctgtgggaccaaatgcggatgaatacaaggcagaaccctgaaggagggagcagccaacaattattataaaaccatgaatcgatcttaaaaacatcatgccgagagaaaagcttaaaaccaaaaaaaaaagagatagttattgaaagatcatttacatatacgaagacatatgagcacaaaaatacattttgctgggagtcctgacaaaatattgaaaattggatatacgtgaacagtggtctgtatcagaaaagggaagggagatctatagggataaaagggaatgaatgaatgaatgaatgaagaggaaggcataaggccttgactgattcttcacatttctactttaagagactgaggaatgaagagggaccaggaaagcctgtggaagtaggaggaaaatcaggagctttttgcttgttaaaatccaagagaagagaataacttagagaagagtcagcaaagcttggattttaatttaggtgaaaagataaggagagaaatggggtcaacaggtaggaaagggaaagtcaggttgagagaagaacagaagatattactgaagcaggggacagagaggtttgcacacataagccccttgagtaagcacaagagaataggcgctgtagtgcctctagaaacagggaaggtagactatctggttacacatgcaggtgggtggattgatgtaatggctggagctgtggaaagcctattctgatatattctattttcataggatgcagaaagcaagtatgattgctaggcatcattaaggccctgcttgatgttagtaatcccaaatcttattcaagattattgcaataggggaaggagaattaattccatggaacaaaaggtaggagagcttttaagcactggggtgagctagtggaaaagtcacataggtaaatccagtgggggtactctaggagggaggcagttgttcattgtgattaggccatctgtgtttgctatttgttcctgatggaagttaggctcccatcctcccaagagactgagagaaaaggatctgtctcttttcttctaagattacatttcaaaaggatggttccaaggtccttgagaaggacattcctggggtgtgaaatcagctgggagaagattttcatcacaaagaggcagattaagaattttcagttgaaatttctttaaaagtaagtgctccaagtaaagggaaatcaggagccttgagtcaggaagctgactgtctaaagtttagtcaaaagtttagtcaagcagaggggaatattaagccctcttggacactagaacatttgattatgtgtctgttttttagcctcattcgtttacctggattcactttccaggtagatatagaattggatttaaccaggattgttattttgccaagcgaagatgggtggttgatagagggaatggggcgttgagtgcatatggagagtgattgtaatgattgaccttggaatttaaacagggcaaggaggagacaagcaccagatgggcaatggccagtgagaagtggtaggatcagtgacttttagtctcatgaggttaaagaatttctggagtagggctataagaagggataagttagaaagatagtgaaaatgcttttgtctctaggtactgactataccagtaattctgtgatccatatacagattcttagctggtggtttattgaagtcagctttgctgtgacttactggtctccttcatctatgtgaacacaaagtgaagcagaacattgtcacatttgactcctatgttcaagtataaaaaatttatgagaaaaagtactggctatatttctctctgaatgtgctgacctataacctctgtaaatataaaactacttttccaagttggtcttttgccttttgctttttttattgaatacactgaagactctctggtgacattgtgtgttgttgtttttaaatcaaactaaagcacaaatttattagccccagtcaacctcctaaaaaaaaaaaaaaacccaacaaaacaaagacttcatgaaattctttaatcattgtctttcttttccacagctgtaaaagtatttgctattttgtgtaacaaaagccatagctctataaataattctgaccaaagaaatgttttagtattttatgtcagattttctaatcagaagatgccttaatttgtgtttggattgtgtgagccatagtacagtccataccaatgctgaattaaaatggaaacagattattaagtactcatacatttgttttcaggatgtaaaaatgaagtaaacacacaaaatgcaaagtagacatgtaaatacagtacccagtacaaacaaagtgtttaactcaagttgaataaacaggcacaatgagaaactaaattatatatcagataaagtgaagcaaatttggaagagcaaaagcaatactgaagtcacataacattaaggggaaatgtgcttgcataataattgagctgtctatctcaaatagccacaagaagatgaaagaaccccagataattttgaaaggaaagcagtaccattaaagccttcaacaaagaagtttatagctttgttcgtttgacaaatatttatggagcacttgccatgtgccaggaattgtttcagggcctggagattcaggactgcgctctctcatagcatgtgtttcagtgaaggatactatgataaggaaggaaggaaaataacatcaagtgagaaggctacttctgtaattactaagggaagaactctctgaggaggtgatatttaaaccaagatctaaatgaacgtatggggagccatgtgcatctggtggaaggaagagcagacacaccattttaaagtaggaatgagtttgctgctcttaaagaacagaaggaatatttgtggatggtggtagtgtgttgagaggaggctacagaaaattaagcaggaccaagttgcagagggttctgccagtcatgataaggagtctggtttttattctaaatgtaatggggagatttttatggttgtaagtagtaaagtgacataagctgagttacgttttaataacatctctct

SEQ ID NO: 1386 - DNA, 1858 bp, Homo sapiens
ggctgcatgcatcggtaatcagaacgcaatagaacacgacaggaatttttacaatgcttttccatacaatgtctggaatctatagataacataaccagttaggtcaggggttgatctttaactatcaggtccagggcgtggcgctgggctgtctgcctgtggattccatttctgccttttagtttttacttcttctttctttggaggcagaaattgggcataagacaatatgaggggtggtctcctcccttaatttgggtggataagatacagaaaaacaagaagtttgtgagcatctcctatgtgtcaggcacagagcaagacacttcacaagaggtgtggaggaactgatccaggaccacagcaggcaggtggccagagacacttgaaactctgcctcttgatacccagttcctgtactttctaacacaccccactgcaatctgagaatggtaataagttctttttattcccttagttttgatgtaatatgcattatgcaaacttcaatactttgcctctaacactcatttttgttgctggagacagacctctcactatttcttaaatttcaaaaaatgtaattaaaaactgccattgaacatcagaaataaaaaaaaatccatggaattatggattaaggcagttttgccagcactttccccaaaattttaagaagctaattttggttttggccattaagcagaacctggcctgataaatgtgaattgaatgaaagggtccatgaacctagcaagaaaaatacatgaatcctcaaacaacaaaattcaagaacccacacattccctcctcatgagcccaacaccccatcacattcatcagagcggcagaaggaagcattcgtcaaactccaggctctgcacatcctttggtgatgttagagtcagcaagaatctttttgtttatccttagcagaatgatccttagcaggatcccacgtgagggaactttgttttaggaagggagaatggcatatttcagaaagatttatccaaagtgagacaattggaaatatgtaactaaaggactatacttcaacaataatatttgtcaggaaactaacttcctgtccttaattagcctaatagtttttaaagaggtgagactgtctttgggatggtggggggtagtggggaggaagtgacagataacagtaatctaaaggtattgccaatgtctctgtcctgtcagattcaattttggcctagttgcaattctgggcaaatgggaggaagtggtgctgccaacccaggtgagtacctctgaggtggagagttctgctccgttctggggactgacagtatatcatcacatggtcaaagcaggaacttggtaagaataaagcacaggagtaattcttgataaaccacacagtgctccaaaggagaatatatacaactcggaaaaattctgaaagataatattccatattttagctacagcatttacacaccactactgccaagaaaactaagctggttttgaagaatgcaatggtctttttaaattacactttcagacaatgagcactgaaatagaaaaacagagctatgacaagttaagttgacttctatcatcagaattcaatattgtgacaatcttagtgtggtgaaaccattgaatataggactatttaataacaattctcatatattgagggcttaactttctctagtccccattctaagagcttcacacagagtaacacaagagtaacacattcgttctcatacaagtctatgagaaaaaagaagaaaaccactcagagtggttatgcaatttatctaaggatatgggtgatagagccactattggaattcagattccctggtaccat

SEQ ID NO: 1387 - DNA, 2739 bp, Homo sapiens
ttgtgtgaggttaaacacacacaggagtcatgtgtcttttatatcagtgatcagaaatgtaataagagggagcaggcagtgtggaaaagtgtgctctctaggaaaacaatggaagtgttcaaagaatgtgggtacaatgcactgttataaaaacatccttggcaggagagagggatcctgggatttttttttttttttttttttgagatggaattttactcttgttgcccaggctggagtgcaatggcgtgatctcggctcactgcaacctccacctactgagttcaagtgactctcctgcttcagcctcctaagtagctgggattacaggtgatgccaccacacccagctaattttttgtatttttagtagagacagggtttcatcatgttggccaggctggtcttgaactcctgacctcagatgatccacctgccatggcctcccaaagtgctgggattacaggtgtgagccacaacgcccagccgggattgtgggattttaaagggaaaggaggaaaattttgcatctcacgttctaagaatataatccacaaaaaaaaaaggatatgtttggaagatacctggaaggaggaaaaatatagggtatgaagtgagaatgaaagattatgaagtatgaatctaggagaagtagtagaaatagtttgggggacttatattcttaaaacatcaacataaggtatgtttaaattgtaacccaggccagagagtcatgaataatcagtttgtcttggagaattctggaattataaacaaaaggatacaaagcattgtccaaggtaaatattgacataactgaagaggaactagaaaaactcttaatgaggccaaaaatactgcatctggggcagatgtttcacattctaacaataaacactcgggtacaagaactctaaggatgaggggtaagaatggtgtccaataggttgaaaaattgactttgaacaaagaccttctcaaatttaaaacagtgatactataaaaacatgaatattaatttttaagaccatgttatttcttaaaataagggcaattctctctgccagacactcatttgcccacaaatatgaggggattagtgttcatatcctgaagcagccatctggtttatacagtgacaaatgcacagtggtttcttcctcaactcccagctgcccaggagtgaagtggtctgggaagccccagcacgacagctgggccactactaggtctaagccctccagcccctgcaatgacaaacctttttgctgagacacacccccgctccaccatcaaggatggctatggaaggacttcactaattccttcggattcatgccctgcttcctcccaggaggatgttcaggtggggtaacctgaaacagaataaacagaagcccattattgctgcttagtgggagccagtgaaggatcttgtcagcagaaaagcgccatggcaaccagttcttcaaagcatttttttaaaactacaagttgaatttcatctggaaacatcccaattacccaattagactaagctgcaaagtctttttagaataagctcagatcataagtgagtgaatagctcaaacccaaaccattgctttctgatacccagaaaatataagtttgttggtactgtattctggtagaaagacagtttattagcagggagaacgaaaccagtctgcatttgtacaaagtctcagtgctacggtaacatatgactatatcccattgggagccatgagatcctggttttatttttcccacttaacagatgggaaaactaaggagctataagtagactcatccctgggggacagagaaagaggccagggtaaggcaaatctggattttcttgcttttgtgtttatttctgtatagctccaaggagtcagagaaatcagcatccaagccctgtaggttccacccctgaaatgtctcatccctcaccttcttctccaccctctctccattgtgcaagtcagacttggaggacctgccacctgggaaagtgttctcttctgctcctgctcttgctggacatgtctatgacagcatggggcacatcacagcccccacccccaccatgctgaattgtctcttgtgggctgaattatgcacccccccaaatccatatgctgaagttctagcccccagtacctcaaaatatgactggacttggagatagggccttcaaagaggtaatcaaaataaaatgaggtcatacggatgggccctagtccaataggactggtgtctctataaggagaaaagattaagacacagaaaacacgctgacccagggaatgaccacaggaagacacagtgagaaggtggccacttgcaagcccaggagagaggcctcagagaaaaccaaccctgctaagaccttggtcttggacttccagcctccagaactgtaagaataaatgtctgtttcttaagcacccagtctgtggtatcttgttacggcacccctcacagactgctccactgctcttccgatggcagttcaggtctcctcaatgtcacaggctgatagaattatctgctataccctcacccaccacaagtcgcatgctccagccacaccatgcactttcaacactctattaatttccagaaatattccccatcaacttaaaattacttctctacctttgctttctgttaaagtcttcctcatgcctcaaggccaggcccaggagagccagttcataaagtgctccctaat

SEQ ID NO: 1388 - DNA, 1725 bp, Homo sapiens
tggtataatgtcagactcacacttaggcttttcaaaagttcactatatatcaacaaatcttaactgctgctagaactaagagagggacaagtggccattctctgctattattcatttattctgaacaagtttctacagtgcctttcacaataagctcttatttttccctattgttcacataatgaatccccaaaaagttgaagtattaaagaaaactgtggagaaagaatcaaagtaggctgggcatggtggctcacgcctataatgccagaactttgggagggtgaggcaggagaattgcttgaacccgggaggcggaggctgcagtgagccaagatcgtgccactgcactccagcctgagtgacagaatgagactgtctcaaaaaaataactagaagggggttttaaattgataacacattataacgtttcccacttaaaataatgggaagtagactcactgtgagcactttagggcagaatatgttattttcaagaaaagattatcgacaataagtggggtgccttcatttgccaggcactgttccaggtgttaaaacgacaacaatcaacgaaataggggaggagaatgtataaatatgtaaacatacatttatatatttatctatttttcctctcttatacaggaagaaaaatagatagaaaaatatataattgtatcaagcccatgaagctaagtaaagcatggtgaagggattaaggtcaggggagagtgctatttcagatggccaaaggagaagaaggcctatctgcaaaagtaacacttgagtgaagacctgaaaggaagaaaggagccacaagaagaacagaaggaagagtatttcaggcagaggacaatacatataaaggctaaggtgagtacatgctaggtgtgtttgacaaacaaggaggtcactgtgactggagtatagtgagggaggcagagtgatttgagatgtccaaaaggtaagtagggggcagacagacagacaataccacagtcctggtggggcacggtaaggaacactggatttggagtgagatgtgcagcaaatggtaggttccgagcagagtcatgtgctatgatctgacttgtatcaaaattaaatgattcctctggctgctgtgtggagaacagactacagaggccaggagtgaaaaatgaagacaccaactaaaaggctactgcaactgaccaggcaagagctgttgcaggcctggaatagaacggtggtggtggggtggtgagaaatggttgagattcctgatatattctctaagtttcagtgcaaagacaggatgtgaaagcagggagagaattaaagacatctccaaggcttctggtccaagcaactagaaaaatggaattgttatgaactgaaatgaggctgactgagaaacagataaaggaggtaagaattcagtttggggcaaataagtttaagactgtttttgatatctaggtgcattatttgagattgttttcagtatctagatgcatccaggcaactggatatatgagtctggagttagaagagaaataggtattggagatataaatttgggagttatcagtatatacatgaaatttaatgaaagttagttaggtgaagtccaaggaccaaatactgggacacaagcactccattaaatgaagagcaatgaacaaaggagacaagcaatgaataaatggttactgaggtggaagaaaaatcaagaaagtg

SEQ ID NO: 1389 - DNA, 2243 bp, Homo sapiens
ctcccattggtctttccctttctggtcccatttgtaaataaatattaaaaattcttggtgtctgttgctttaaaaaagcattttggattgccatttacatttttaatgtaatcaaatttaatttccctttacctctgtatgtagccggcgttataacttggatttagatacaatatatgctacaacttagtcatttctggaagatgaggtaggggccccttgggagtcaattgcatgagatcttgagttagacttcatccaaaaagaagttggaaatgagatggtcaggtttacttcaagggcagcgctgggggcagaggagagggctgatcactatgttagtccctcaggcttgatgctgtgttacttaatacactttaagcaacatgggcacttattagtaggatatatggtgtcccatgtgtgtatttcaggtggtactgtgaagccagccactctgttgtcaaggaggcttgtttatttgattgtccttacctgaatcagctacacgtctttcatgaactccaggatacctgtctctggagataagaacagctgtgttcagtcaagatcaggcatcaaaacagacccatagttactggcagaacagcctcatcagactttggggagatgaatctttataaacagccatgaaattacttgatgcaattggccctttcaaacactgctctttacccattggctgttaccattggtgccatacatgtaagcagtcactagagtatcctcagccattcagctgaatatgttcccagcatcattctgctgtcagtcaactgggagaccaatatagtattggtctcttatggcaacagcaggtgtgtgtgtgtgcatgtgtgtgtgtgtgtgtgtgtgtgtgtgtgtgtagtcatgtgtagatggcaagtattaagtacaacatggctctctgatcaatgtagcccattcttttttttttttttttaagaatctggccacttatatttattcataggaaattaaattccctgtatgttgggcagctggaattttattactttcaggaggaacaataaatgtttttaaacatcagtttatacaaagcatctaaagtctcctccaacatattctgttcatcaccggaggtcctggctctatgaagaatgatcaaacttggtaaacagtttctctaaatagaatgtgtgaaataattatctgtggttcttgacgtatacagaataggaaggagtaaattacatatagaatttggagctagaaatcctcctatgaaattcagattaatgattggttttatacttagcgtccctcttccaggagattaataaagcagggctgattctatacatttaataactatttacctggtgtgatttgggaggcataaaaattatctgcctcaatatagtttttttttacccaaatgataatatctatctctaagattcatccttttaggttaaatattgcctccttacctagttctctttgttggaagtagataattcataatgctacttatattttggtgttaatttctttattcagtatacctctctctctcataagaagatgggtgtgtgcgtgtgtgtgtgtttatgtgtttgactgtactagtcacagggttatggctatggactactgtatacctagagagagggctggaggttggctgggtaggaagcatttgtaagacatacttttaaattttgcacaaggcattatcttaggacttattttggggttatagccttagaattcttgatatagagaatttctttttctcagtgatcgtattttacatcacaggtaatgattcccatcgacctagctgttatcatatgcccgccccagggccaatcacagtgatcatgagtttaaagacatgggattggtcaatttaggccacacgcctcagatacctgaaagcaggggttggtggtgtattgtacttggcagcctcatcagaaccatgtggagtaagggaagagagttttccaaaggcagatggggttgctatctgtgctagaaaaggaaaaggcatggcaaaacacaaatgacactaaccactggactcttctgactcaaaatcatctccactcagaattttattgtgtaaaataattcattctaaccagaagggtgtggtgagtgagtgaaggctagatgtttggaatatgtgcacccctggggaaggggtgattctgaaactctgcctctctgtgcttgagatgaaataaatcaat

SEQ ID NO: 1390 - DNA, 2423 bp, Homo sapiens
gtgtgagtgtgaactggtatatgtgtttggatttgaatgtgcatgagtgtgcatgcccgtgtggctgagtgtgtgagcctgcaggggactgtgacagcgcatgtgggtttgagcgtgcactgcacatcaccagagccgtgctctgcttgtttttgcaatcactatgatttgctggatttcagccgagcattcaatcctccgtgagacataaagaaaatgaattttattccctggggacattgcatccagcccagggggacaagtgcatggcgtggtcagtggttacagagcagctggcatgctgactttgcttatcaggagtgatggctcctctggggagcaccacggctgggagccagaagcctactgtgtgaccttggcctggtctctggccctctctgggcttggctgtttgcccaagtgagagaaggatgcagagaaacaagactggcaggagagaccggaaccacaggcatggccttttccaggtccacatcctcagctttgggctctgtctagacaggcacccactcccacaggctgtgggtcttcccaggagggcccatggagccatcttaaggacttgcactagcagtcaattggcatgcaggagtgtgggtagaagaaaggcaatgagcctccgagccaggcattcctggttcagaccccaggaccactgctcacagtaatacgaactgaagccatcacctaaccaccaccccagcactcactctgagctgcagctgagtgctctacctccaccacctcatgtgcatctcccaacagctcaaggaggaaggtagaattagtcccattttataggtgggaaaactgagactgaaaatgcctcagtgacatgctctgagctaaggggtggctctgaccacctgctgagctgccttcctgggcttcacatctgcggaatgagagtagtgatgtcagcttggtggacttgtcttgggctgaatgagacactgtgggtggggaggggccagcacggaacctggctctcagtgaccatgctgtgagtggccccgggctcctctgggtaggagaggccctgggaggaaggaaggaggcctggacctctgggagccccacttgctagctgcctcaacctggatgaggactgggctgagatgagggctgagggtggggtcccaagggaggatcgggtcttatactatccccttcaccgtggtgaaaacagacactgaagccttcagaacacagccctgaagcacgttccaccccagggtgctgaccaggggcaggaggaagcagccctgtgtccacaggccttgtctccccagtggcctcctgagaatggcacagagcagaaaccttccccctgcccccagcccactgaggatccaggtgcccctaattaaaccccaggaagggaggtggcaacaggagaggttaattggccgggcctggtatggcctgataagcctctgtctgtgttcctggggaaggtggggtgtgagttgtgaatgtgctcatgcatctaattgcagggtcacccaccccccggctctgtaatctccacggagcccgaggctaccagctcccctaccacagggcccccttggtcagtctccccgcttccaacctagaaattggtcacccctctgcagccttgtactgagagccacctgcccccaacctcagtcacctggccccgcacacagctccagctaatccttgaccttgaggggatgcttgattacagtcagggctctggctatcaggcccaggtcttctctccggaggtccctttctcactggaatggtgtgtggatgtgggggcatttgggggaaagctggggactctgttcagggatgtccttgaaaatctcaagataaaaacatatgtgaatggagcaaagatagtcttttcaacaaatggtgctggaataactggaccatccacacgcaaaaaaaagaaaaaaaaggatctagacacaaatcttatactgttcaaaaaattaactcaaaaccgattaaagacttaaatgtaaaatgcaaaactataaaactcctagaagataacatagaagaaaacctagatgaccttgggtatggcaataactttttagatatgaaactggaggcatagtccatgaaagaaataattgataagttggtcttcattagaattaaaataaaaacttctgccctgtgaaagacactgccaagagaatgagaagaccagctacaaactgggagaaaacatttgcaaaagacacagttgataaaggactggtatccaaaatatacaaagaactcttagaactcaacaataaggaaacacaaacaatggccaggcatggtggctcatgcctgtaatcccagcaatttagaaggctgaggcaggtggattacttgagctcaggacctgggcaacatggcaaaccccc

SEQ ID NO: 1391 - DNA, 2098 bp, Homo sapiens
cttaccagcctatgtaaggccgaatcctactaacaaagcactggtatatgtaatatcccagtggtttgcttctctaattgaaccctgactactacaggtaagaattttgacaagaatatattaattcttctaggatgaagaaagggaaactcacttcaggtcaatagagattgtcatttgggaccccttcaagacaaccaattatatgactgtctctaaaatattgctatccagcccccattcctcacttttgtcctactggtaataagacattcatcgtgtatctttcagaagtccagataccacagtctgagtagttctttaatctgcttatctggtgattccatcacaaatggttcaggtaagtctggcatgccttgggcttggtgtgattttctacacaaaacacagattataggtggacctgacaattaatctaattaataagaaatgctacattcaaagcattttatcccagactcagctatctcagttataagaaacatatgttttctatttgagaacccttggatttatgcacattcaatttggaggttagaaggaataaggatgagagttcgtagtgtctgctttatccaagcctttttacaaggtgaagatgtgttaactagttactattttgagctcttcatactaaagttttgagtgaaaaacacaatctgctaagtcaaggcaacaatatttttctttttttgaacttactgcaccatttaaattatgaagaaatcaaatgttaataatcataaacactttgtgttgtaaaacggctttcccctctctttccttcactgtacactgtactaaaatgtttcagatacttccagagacaactgcctttagaggagtcatacacattctccttcagcctggacactaactcagtaagcagcagcttcagaataatgcacctgtgatcaggccaattgggatagaggcatcatctgcccttatcttctcagagccaaagaaactaacttaattttccgtatcagcttcattttcccctttactcaatgcccagagattaattcttggtttcagccccaccccatgaaaaggatgtctattcaatcagagagacacaaagatggcttgtgcaaaccaagcaaaaaagacacaagaggaatttattctggttaataagctgagagcaaacatgtagaggctaattgtatggtgagtacaagaagagtttcttatctggggagtgtataatgttggggtagacactgtcatttgttttcttatccaatagccatcattcttcattgcttagaaaaaaaaactttgtgctacagctgtcaggcaagtggcatgggatttaggagaaaattatttgctgtcagccctgaaggatgaaggaatcacaatttctctgtacaatcatggtagtcagctttcaagattcctccaatgattctcatctcctgctattcatgcccttgtgtagttatctcttgcacagaatagggctgatgtgtgaccagtaggatattatggaaatggcagaatttgatgttcataaaagatgttgcagcttttacctcgctctctcagattattcaccctggagaaggctgttgtttatcttttcacattgtgaaaacattcaagtggccctctgtgaagtccatgtgattgggacttgaggcttcctgacaatagccaccacgaatttgccgaccatgtgagtggcacaactttgttcaggtgactggaggcccagctggcattttgcctgctatttcataagagactccaagccagaaccatccaacagagccaactaagtctcttccaaattcctggcccaaagaaactctgagagataatacatatttattgttatttaagccactgaatttcagagtaatttgttatgcagaaataaataacaccaattgtgttgaatcccatttctctctcatggtatatatgtagtcagaaaaccatagactaaaatccacaggcatatatgatagtccttgacattacccatgtcttagtttaataatcctggctagttaagtactgctaatccatatctccagaaaaatttagaaagccctgatttgca

SEQ ID NO: 1392 - DNA, 2500 bp, Homo sapiens
ggttgggtcagtctgctcaagaagcccatgcaatgcctccaggtggtgaggaaggcttcgtgcagggacagcattcccaggtgttcctaggggacctactgggctagccagtcagatagctcatgtttactccagaatccacatttcttccccaccacacttaggagatacgttaaaatgctttgcgtataagcaccctgagaacctctgccaaaccctggccagagacagtggaaccatatcttccccgatgaagccagcatgccctatttccccactccagcaagtgcagtgctgtacactgatattcctggaatcatcacagatggaagagaggggctctggagggagtaaaatccggacttgaatcctgttcaatgcctaagtggctatttgtgtgaccttaagtaagtcatttaacatctttagcttttccatttcctctgtctgcaaagtgtgaggattagagaatgcacaaagggccagagccatcgtgggcacccaagaaacctcagcttcctccctactaatgacaggcgcatgagaacagggatcaagactcttatcatcggcggagactgaagactacggtgggagctgttggcccaaagtccaaatgccatcgttcccctcaatctcctgccaacaatcccagggacttgactgacgttaagagtccagcaaaagaaactgtagaatactagagggtgggggatttagaaatgacctattggatactattctcaccacctaggtgatgggatccgtactctaaacctcagcatcacacaagattcccatgtaacaaatctgcacatgtaccccctgtacctaaaataaaagttgaaatttaaaaataaaataatggtctgacaaaaaaaaaagtggccaccccagagccttccccattcccatcacacccagcaatgcaagcaggacaaagcaagcccagcgaatccaccactgcaggcgtttgcataattaaccacttggcaataacatccttaggccagtcttagttatgtgttaaatcctcacagggctagaaacaggaaggggctaaaatcctctagaacgaaaatgcatgaatatgtgcagtgaaaagaaaacagatgcttcttgaaaagctatatgctaaatgctttatcatagctgtctccttcatcccttttaacagatgaagaaacagaggctaagacggtgatgcaaatggcccaaggtcacacaaataataagtcaaggagctgggacttgcccccacatccattcaactccaaagccaatagtctttccacccccaagcttcacagcagagcaagaaggaaaggaagcaaggggaacgggcaaggaattggcaagaagcaagaagggagggggccagcgatgagattagtcgataccatcaccagtacagaatccagctggggaaatactgcaagaagagccatcccctgagcagacttttgcaaacacacagctgggtatattctgagaaagaatggacatgttagtgctgctaatcccaggctgtccattactggactgaatcacttcatacagggcaacatgttctggtgaaaatgccgggagccgacaggacatcacagcctggcggaccaccggcgtgattcggggcctgattagcagagagcatcagggctgccggccagttgtaccacattaagcattccaaattttaagttccccagcagtgggctttgggctggctcctgatgcatgaggtagcattctgagtaataattaattagaaggaaaagcagaataagcaagcaaagtacatcaaatggaattagtataatgtcatgtttcacttcagtttactttcaatcagagagggccaacaaggtgactggggttgtctggagaatctgcagggagcccttggccaccctgtgacctgttcaatctgcctctgctcccaggcataccacatccccagctcaccccccaaaaccaacccaggccagagggagacctgccaactccagcctctcacctctctgccattagactacctgggccagcgccaatcagccaactcataggttatttctagtttcttctcaaattaatggattctttacaaatgaatggattctttactaaccaatggattcttaaactgatgggccctgtcttcattagaaggctccaacctcgaacagagatgtttttaaaagaaattcacactgattattagcccaagtgccaaaaaaataagaacatctaatgtatccttcaacgataggcaaagacacctcctccaggtgctaagaaatcccaaggcagacctacccacctctgcagaaagctggaaatttattttatccctagaggcttacacctgtcaacaaagagaggaaaattaaaaagaaaaaaaaaagggctgagtcttgcctcagaaatctctgtcagtgacttgtaaacaggcttccaccagcctccccacagctcttcagaggctgggcaggccttgact

SEQ ID NO: 1393 - DNA, 2669 bp, Homo sapiens
ggactgagagatccacaagggtatgccctcatcttgttcatctcagttgctcccagacccctgtcaatcacataatgggtgctccataaatgtgtggtgaatgaatgactgaacggatggatgaatagttggtgggaggaagtagtagaaggaaggaatctttggagccagatgggctcaggcgggagcccagaacctttttcaggacctgttggagttcttgagaggcccaaggaagatcaggaaaattctagcagggagctggtgaggaccgagtggagtggagtgatacgtcagttgcggtgcttgctgccgactggggagtgatggacatgctccctaagtgtgggtcgacctctctttctccttcctttcatgaatacttgtttagggcctcctaggtgcttggtattatgttccctgctctcccgtatattatttcatttcatcatccggatagtactgtgagggaggcattattatccccatgttatatgagaaaattgaggttcagagagggtcagcaacttgcccagagtcacacagccaagaagcagcagagtcaggacttgaacccaggacttcctcctgtggatatgagaagtgactgggggtaatgccactctgttgaacactgacccaaactggcatgctggggaaggcagccctaggggagcagacccttccatgataatcaagtcaccgaggttgcagcaggtttgacccagttggctgggttgttgcctttagggagctcacagtctagaggtagagggggagccagctgatatacaaatacgcaaatagcttatcattgcaactagggtgacttcctgggagatgggtggagaggcgccccagggcctgctctttgtgggagctggaaagagcaccagatgcagagtgagagctgcctatgcctattaggctttgcctctaccacttctgggctgtgggaactcaggcacatgaatccctgtgcctcagtttcctcatctgcaaaacagggacaggaagaacttctttgtagatttttttggaagattaaatgagaggtacttgaaagtgcttaaaactgctagtgttaagtattcaaagggttttgtacaatcacaagaggtgggcggcatggcccccccaccgctttgccttggctatggctatgtggggcccttgggaccccagatttataaaatgttgcagctgaaagctctcctatattctcctgaccacccaggggctgtgaaggcggtactaaaggttcataaatgattctccatgtttccccaaatcaacacagaagggttcatttgctgtaaacaaaacagcagacttctttgcttttggctgaattacagctctcaggatggaactcctctcatgctgaacagaagtcggctggcagtccctgcatctctgattaatataaaaaacagaggctgggagggggaactgacttgctggcacgggacaataggtcagagaggcttcaggctactttgtgctgggcgccaggggaggaagtgaggaacccccagggaggaccctgggggcaggattgtggaggggaaatccagggcaggagtgttaggggtgggggcaggagtgacagggaatcctgggcagacaatggcctccttaaggagagggtgagggtgtggagaagcggcatggccacagctagtgagggtgaggaagtagcggactgaggctcttccccctaaccccagccaatggagcaattgtcctctgctgggagggagctgggcctgggcctgggaacagctggatgcctgcccttagggccaccgaggtggtcctggcctccttgcctggtcccagaatagctcctctgtgcaggctgctgatccttcaggccccagtaggggttacccagtcctacttcttccagttggcagtttggggtatggatgcccacccaaggctctctgaagaggggcccccacttcccttctgcccacttctgggaaacctgagccctgtttaggctggtcgctgaggccagggctcagcccacttcctggagctgtctgtttccagctctaccctgctgccctgtggccggctggcttggcttttgggtctcagctgctttacctgtaaagtgagagagttgagctatgaacagcagtgcctctcccccagtggatagcctgtccggcctggggtggggcatgggctcagtcctcaggacccctggggctggcactcaggggaagggccagggctgctaacttcctgctgggttcagcacagccctacaggatcaagaactgccatgccccaagagccgatagagcccctgttgagatgcactgctagatcgatgcttttcactcttgttgtttttagggtagcgccatcctgttttcaaacgatgtggcttgtgggaactcgacagataaaacagatgaaaggggcaagtatggttagggctggtggggggcccagtgggaaccctccctaggccctcagccgggcctctctgcagctggctgtgccctgtgtgcgcggttctgggtgttctgttctgattgatggggcatctgctgaaactggcaatgtccgtgctgtaccggttgttactccttaccctggcacatgccgcagggttttgtctttttgtttaatctaagagataggatggg

SEQ ID NO: 1394 - DNA, 2885 bp, Homo sapiens
actcagtgcccactctgttaccacagggatggcacccagatgggaagctgcctgaggctgcagggaggctgggatcacaaactcaggcctgttcccagagaggggctcatcagactgtggggacaacggctccagcctcttaggtgggggctgggcagtcccctctgggtggttctcatgtttgttgtcactgccgctaagggctgcagtgagctgtgtgcagcctggactcactccctctgctggaacctgggccgtgtgtgggttgccacaagtgagcgtgttctctaatatgagggcaggttcattctgttttgggataggaagtttgttctaccccgaggccagatttgaatccaaactcagctcttctagagatgaggtcctggggagggggtgaggatttactaaacgggtaaaaccaaatctgggtgcttatctgactgagaggcattcaacccttccattttcaaatggtaatcataataataatagtagctgacgtttatttagcacttcctatgtgccaggcactaggctaagactctacataattagtcattcaattctcacagcaaccctctatggcatggattcttatttcccattttacatatggggaaactgaggctcatggacgttaagtaactgggaaattgcagatcttggctttgaatctaggcaatctgactccaaactgcaaggaagaagacagatccagcctcagaggccgcttaacagcttgagggcctcagccgtcctgggattaggatcaggcagattcccagggaaggacttggagccatgcctgggttttgaggccgggctggcacctccacttccagggcatcacgggagggtgcatgggctgtgctcgcaggcatgcgggacccagaggcagcccggtgaagggtagtgggggactcgactcactgtgggcctggggaggtgtggtttctctctgctggcttagttacaggtggtggcctgtctctccggggtctggctgtagccatgtccctgcacccaccttgccagccagggacaggccccatcaagacccaggagcagctccagcctcagccagactgtccccgaggtcccaagtgaggccccagccactcaggcatgcctcaggaagctcctgctgcacatgctcctctccctgcgccagcaccctgctgtctggcttccttcctttggccacagggcgggtgtgtgtgaaaccacagggtttacagaagctcgaggtgccactgagtggcaggattatgcactgcactcggggaatcaaaggtggagacagaaagaactatggctgttgtgacacgtcccccacggctccccggttggcagccactgccacccgcagggacttttctgtggcttccagaggtgtggggcaaaggtggagtctggtgactttctccctagggccagcccctgggctgtcgagcctgggaaactccacatccctctccacacctctagaaggactcacaatgaggggggcccagacaggaggcatcaccacctggtttgggctttaccattcacccagggataaggcaaggcaaacaccactccacatcagatctgaatttgagctctggcttcatgacactgacacatgaagactcttggagcctcagattccccagttgttaaatagggagactaatatctcacagagttgtttagacccgaggcgttcaaccttggtggcaatggatgtcaactggaagcatgaaaaatcaccaatgcctgatcctatcctcagagattctgatttaattgttttgggggacagcttgggcatcaggattttaaagagtttccctggtgattttaatgtgaaggtaaggctgagaatccctggttttgacagtacctatagcctataagcctttaatacacctctgaaaatgcctgagacctgaataagaagtttatggttccacagaagcagccagacacaaaaatgcatatgcaccatgtgattccccttatatgaaactgaaagacaggccaaactcgcctttgattgggagtcaggatcaagattaccctgggtcgggggtagcgaatggatggggacctggggggcttctgggagctcaggatgttctgtttcttgatcagagtgccagttacacggggtgctcacttcatgagaattcactgagctgtatacttaagagctgtgtatttgtctgtactggtgatatatttcaataaaattcaccagaaaagcctgttggctacaaaataggaaaagaaaggacacacttgaaattaacgttttgttaaatatctggaaatgtaacacatatgccaaacagacaactgcaactctatgttacgtgtgtgtgtgtgtgtgtgtgtgaaaatgtaatgtctgctctgctgtgggtgggccctctaaaagggaaggtccctgatgcctaagaaaatctgaaaacagcccaggttcacaccaggagttcttaacctcgacccgactgcattcaggtgcatattatgtgccgttatctgaggagagcatctacagctttcagcagattctcaaaggggtatgcaaccccctaaaaaggttaagaacaattggttttgaggagtcagtaagaaactggccatgaatgtgcttggcatgaaagagatgcttggtaatgtcggtttctttccttcctttcagagcccagccttcggaggtttccgcatgagccttctcgggcgacttctaggaggatttattcccctggcagtgccaagggcagcctgcaccaagctcacaactcttcctccaagaggatgttcaaagggcctgtcatttcagcatctgctggacagcagaacttcgcatgcaggatcctggagctgcgtcg

SEQ ID NO: 1395 - DNA, 2405 bp, Homo sapiens
tcttgtctccttgccccagcatccagaagggcagtacacttttcagtatacagactgagggagtgcagagatagaatacctttgcagataatctgacatgagaaaacaagattgagagaaagcagggctggatgctgtggatgagtgtggggtccctggcttacgcctactgttccatgttgagttaaattgaagccaaagtcatgtctcatttgtgcattggtcaccttagccaaccacagcccaacctgaatgcagaatttacatttttctctgcccctcagctgtgaaaagacttgagtttcccctacatcccatttgatcagtttataggcaagcaagctcacatctgggagcaatttccagaggggctccaacaagctgtaagaatgaaggcacccttgactatctgggatatgacattgcagttcttgagtgaaaccccccttccctccttcagccaaacctggagaggtacaaggttgcaggcagtggccgaatgggactatctctccccgttggccctgtacccctcccctctctagtgtcacaaacaggatccttgtcaaaattgacccatccttcttttagatctatgggctttttgtattaataacccttccacatgaccaaggctctctggcttccatcagccttgtagtctcattgtcttgtctggactgaccactggccatgagcaatctcagactgtggtcaatatcagggccgctgtgcagaaccctccctactagagctggaagaatgtcagagcatcaggtccacccaacccttggcagatgaggaaactgaggagaaagaaaagggacccacattgcccaaaactacactgaagaatcctccctaacaactaagggcaggcagcacccaagagagagaaggaagggagggaggtgtcagaggaaccactgtggggccactggtatctgctcagttaatattcctcaccagctgggctcctgagcagaggctgagcctaagagtttgtggacctcaccctcaaactgtgtcagatctcttccccaggaagggtgtggtctagggcctgccctggcaagtctcaaccctatagccgtggtttcctactcccaggctgggccaggaatccctccctgctttaaacctatagctgtgccaccatcagcaatgactaaggggaggagatctctcttcttcctgattggctcttgccaattaagagcactttattaggctgctaattaaaggcacttcgttagcagcaggagaggccaagtgggtgcctggtgagacggaggtgaagcctggagaaattgttttcgtccccccatggaagcagagcctctcagggaagctctcagtccccaccctctcctgctgcgcctacaacaccccttgctttcaattagcaactctgaggggagcaaggtgattaccaaacccaagctggaaccccccaccaccaccagcaccacctcaggctgcatgcggtcctcaggggctggccagacccccaggcacctcatgaacccgggcccagggaaggagaggctgggcagcccaatggggagtgtgctctccccactaaggaatggggcatgactccccaagcagctcaggtgaatgtcacctggtcctcatcattggggccatccctagcagtcactggataaccagtcacttgttcacatagtgtgaatcctcatgctcctttcctcaacaaacactcatgatttcatggaggaaatgtgcccttcccacccgtgagggacagtccctggtcgtttaacaagagcacagcccacgtagaccctgaatgggtcctggaggagagggggctgacagttttacaatcccggccatgcagacccttgagcgactcctgtccctgagctcatgtcgaatgtgaggcgcttcccctggacggtccgaatgagccccctgcaagagaggagagcctggctatgacctagcacgtgggggttggcatgcagggacaccccctctccagagccctgcctgtcccatcttgtgcccacctcacccctcagttaactgcagaattagcaccggccgtgagggcagatttatgactaggcctgcctccctccacttaacccgaggccggcccgggctccagacactaaattagatttttgacaattagagagactaatgggcacatagccatccccagagccagatatccagatccagcaaggccattctttaatatccaccaccagccagcccaaccctcccctggccacccccttctccctcccgtgggtgggcatttctctctccccagcccctgtctctctctgcccgggctctacatgcactcacgagctgtctctggttccccttccctgtctcacctactcttgccttccagccccttgccc

SEQ ID NO: 1396 - DNA, 3031 bp, Homo sapiens
tgggtgggtatggtgagtatcccattttgtcaaatagattataaactccagccgggtgcagtggctcatgccagtaataccagcactttgggaggccgaggtggatggatcacaaggtcaagagatcgagaccatcctggccaacatggtgaaaccccgtctctactaaaaaaaatatataaaaattagctggatgtggtggtgcgcacctgtagtcccagctacttgggagactgaggcacgagaattgcttgaacctgggaggcggaggttgcagtgagctgagattgcaccactgcactccagcctgggtgccagagcaagactcgatctcaaaaaaaaaaaaaaaaaacttcaagtgtagaggtagtatcttttgttctttggtgtattactagagggtgcagtcagtataaattaaatgctagagatcaattattctcttccaaagtaaagagaaaataaacaaccatagcaaaacaaaatgaaacaaccaacaacaaaaaacagtcattaagattcattgtcatggatatagatagatcagaggaaacatttcacatttcttatgtatcagaaggccagtctattcttctagaacctagaggcctctgtcaactcattctatctcagaatagccttaaccagacagatatatttaacttaaataatgacatgaaggcttttttgaatggttccaatagaaacattagaaattgtttattcctaacttttatttagttttgttttctttttttaaaaggaaaacaatttggagactcgtgagattttataggtgtcatctattttgaaacagtttacttttatgatgtttattcattgaagggtgtgaacattatgggttttactgcatggcaaactaatgctgtttttacaatatactttatatatggtgtcagcttttttggtgcctcttctaatgtttccttgttgcatatccgcaaaaaatcatgattagaactgctatatagggctgggtgtggtggctcacgcctgtaatcccagcactttgggaggccaaggtgggcggatcacgaggtcaagagatcctggctaacagggtgaaaccccatctctactaaacatacaaaaacttagctgggcgtggtggcacatgcctgtagtcccagctacttaggaggctgaggcaggagagtcacttgaacccaggaggtggaggttgcagtgtgccgagatcgcgctactgcactgtagcctgggtgacagggtgagactcccatctcaaaaaaaaaacagctgtataaaagactctctttttctttagcatttaactcttaagtaaagaagaaattaaaaagtaaagtaaaattgtaaataagtaattgcacctttatttctgtactgtacatcccataaagatagacaatatgattgacctaaaagttctaaataaataaacttaaatcagaatgtgtggattagggagtaaaatggtagtacgaaaaaattgtcttgtatacagttgctttttagatgtgtaaaaactgtttacttgacacacaatgctttggaattaatcacatatgcaagcatgttgtttgttggggaaaccccttatagtctctacatatgtgaatgaaagatgggatttgtttgaattactctatagccttcattgttaaaatcagaattaagttctttgttcagtgaagcattcgtagcaatccttgagatttctgagcagggctggttgttggcagagagttctcagtgtattatgctgtttacctaagggttttattcaagaagctctctgaacagctgggctgattattgaaaatgcctcatagtaacttccagcctaggctgatcgatatcggtgcaaagctttacatgggagggagttatttaaacattgagagccccagggataaaagagaatgaaaaaataatgctggacaaatatgctgaaatgttcaaaagaagagagaagtatcttgtcttggtatagaggggaaattcctaaacaaacaagctagaaaatttgtaagctgatcttattacaccctaaacatttacttattttaacttatagcaatcccctaaatatttatttatcttataacaacaccctaagtatttggtggcaagaggaaagattaattaaaagtaccaaagatcaattttatttttatttattttgaaatgtaacctattacataaaattccatgagacactttttagtgataatattgggaaatatttaactttattgtcaaatagattcagctctcatagtttaaatgtagcacaaatgtatttcacccaaatgtaagcagaaaattcctatttctttaatttttttttttttttttaactacagagatctagaatacagatattaccatttccttctggcttagtcctagcaaaacaggttgggctttttttttttttcatttctgtttttaaacaatttaataaaataaataaaaactgtactagaaataggagattttatttcctaaaggcatttggtggaattatgacattgaagcaaaagtatcagcatttaaaagcctgtttctttctacaaaatgggagaacagagaaatactccaaaaagggagggaaaaacactcaatttatcaaagtggaagcctgtatcaagaaatcctacatcttgttacatccaggatttcttacttttgctctgctcatgagcaacagacagaaagttcagaaacacaaaggcaatcaatatgaaaactgtgaaagtctcttaattaatcaactcacacaaactctccaagtaagaggattttacaaacatttcaattaaagctttctctttttattactaaatttcattgacaattaaaaatgcataatgagagtcgacatgattataaaaagcaaaatatcatttaaatactgagcttttagacgtataggagactgactttctgatgcttattcttttgatgaatcacatagacaattactaattggatagttattctataacagtgacattttggaattttc

SEQ ID NO: 1397 - DNA, 4876 bp, Homo sapiens
cccgggttcacgccattctcctgcctcagcctcccaagtagctggaactacaggcgcctgccacgacgcctggctaattttttgtatttttagtagcgatggggtttcaccgtgttagccaggatggtctcgatctcctgacctcgtgatctgcccgccttggcctcccaaagtgctgggattacaggtgtgagccaccgcgtctgacctatttttatcttttatgtgtattctttgtttaaatcaactctctctctttttttaatctcctggtttttatggtgtttttgaattttttattttgagatttaatttagaatttttttttctcttccatgtcagggtttggcaaaccaaggtcggtaggccaaatctggtgtgctgcagatttacgtaaacaatgttttatcaaaatacaactctacccagttatttgtgtattatgtttgtttgcttttgcactacagttgcagaaaggaatagttgtgatagagactgtcctgcaaagcataaaatgctatctagtcctttatgtaaaaaaagttttaccaattcctttcttgtagtatatttgtataacctgggttgtggatgtatctacaagggccatttacatctgcttttacaatatctatggggctttttctgttttcagagcaggtttgtattaatattttacttggtggtttattcaccaaatatatgatgtgaatttaagattgccatataagcctgacatatactttaagttcccacaagttatgtttttctttcataaacatatcccaggggacttaaaattcttttctgctttttgtagagcttgtgatgtgttttaatacctttttcatagatagtgtctccagttgataggatcattttatgaacatggttcagtttagcttgcttcctttaggatgccaagaattatatcctcttggtctgctggattttggaacccatgcctcctagttcttattcgtctattccacgtatagtaaaatttggtcgctagctcaaatttagctttactattcttattttgaatctctgcttcatttctagcatctgataattcccatttcttttaaagtggtatatgtgttgaaaaatgctttgggtaaatttttgtcttaaatttctgtgtatatttttaaaatttattaagattgtcacaaagatatttttaaatgttgcgcatctgttgcagagtaactatttttcaaaactatgtacttatttgcatatcaaatgctgagttgtcattatattttattttgatttttttctgtttgtgtgtccataaatgaggagccatctggagtggttttaaaatttagagaaaatagaatggatgacttctctttagttttattcatattccatagctactgagatattagatgatattagaacctttcaagcaacaatgtaaacctcaacactcttatgtgcaagctgacattacctgtcgatctaacactcttttggtagtggggaatagaacataaccataggcttactaatataccattttcttgttatttgatacagccattatgcctgggtccccttttctgtaatatactttctcctttgccattgctaccatattagttataaggtgtgacaattaccagacttttttcagcagatattttttctgcaggtaggtctaaagtatactggctttctgcatcatatatagaccatgtcaggcttccttgatttatactttccaccagatggatgaaggaataccagtgatatgcttcttgactgccctatgactaacctttgttttcagaatttttcttattcaggaaaggagggttgagtggcattttgctagggaacttcttttatcatcaagaggtattatagattactaccttctagttttgttcatgtaggtcaccataatgcctatcattgctggtacatttacttattattttaccattaatctgtgagggagatgttagatatgagtgctaaatttagctgtcttattcagatgttaaaacttttttttttttaatgattcttccaaatggccagaaatttcatgaagttgttacagtaacccatttcttactttaaatcttctggtaagtctttacatgtagtgggcactcaataaattttgtttttacctgagtgaattaattagtggtgtcacagagtaaattttctatgaaacagtaccttgccagggcaactaggcaggagaaggaaataaacggtgttcaattaggaaaagaggaagtcaaattgtccctgtttgcagatgacatgattgtatatcgagaaaaccctattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttaaagggacatgaaggaactcttcaaggagaactacaaaccactgctctaggaaataaaagaggatacaaacaaatggaagaacattccatgctcatgggtaggaagaatcaatatcatgaaaatggccatactgcccaaggtaatttacagattcagtgccatccccatcaagctaccaattactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcacatctacaactatctgatctttgacaaacctgagaaaaacaagcaatggggaaaggattccctatttaataaatggttctgggaaaactggctagccatatgtagaaagctgaaactggatcccttccttacaccttatacaaaaatcaattgaagatggattaaagacttaaacattaggcctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaaacaaacaaccccatcaaaaagtgggcaaaggacatgaacagacacttctcaaaagaagacatttatgcagccaaaaaacacatgaaaaaatgctcaccatcactgaccatcagagaaatgcaaatcaaaaccacaatgagataccatctcacaccagtgagaatagcagtcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaatgtggcacatatacaccatggaatactatgcagccataaaaaatgatgagttcatgtcctttgtagggatatggatgaaattggaaatcatcattctcagtaaactatcgcaagaataaaaaaccaaacaccgcatattctcactcataggtgggaattgaacaatgagaacacatggacacaggaaggggaacatcacactctggggactgttgtggggtggggggaagtggggagggatagcattgggagatatacctaatgctagatgacgagttagtgggtgcagcgcaccagcatggcacatgtatacatatgtaactaacctgcacattgtgcacatgtaccctaaaacttaaagtataataataataaaaaataatttaaaaaaaagaaacagtaccttaagcttttaaggataatgttataaaattaaagtttttaataacattattgtaaagataatattaatttattatagacaattggtaatacagaaaaatcttactttagtaagatacccatcagcttttccataaacgtatttatacatttcatcacaaaattgtcactatgttaaattgaaacaaaatatgcacatgtttcacacggttcaatgcgatgttttaatacaggtatatgttgtataatggtcgaatcatggtaattaacatatctattaccttaaacatttataatgtgtttgttgtgagaacattcagaatcctctcttctagctatttgaaatgcattattgttagctataatcaccttactactgttcttgtactctattgcatcataggtattcctcctatgtgtaatattgtatgcattaaccaacatgtccctatctccccctcctcctattctctccagtttcttgtaatcatcattatactcttaatgtctatgagatcttttttttaaagataccatatatgactgagatcatgtggtgattgtctttctgtgcctggcttatttcacttaagaaaatgtcatctaaactcatccgtgttgt

SEQ ID NO: 1398 - DNA, 1804 bp, Homo sapiens
gaaaaaatagcaggcgtggcaagcagatacaacttcagatgctccacttaaaccttctgttgagcatcccaaaaagctgaaacattgttctggtttttaagtggtcaaattatataatttttatggagcaagaatttattttgctagttatcatattagtatcaatgaacagttttaccctagatgtgctagataaatattgggctaaactatatcaacctagctgggcgtggtggcttatgcctttaattctagcactttgggaggccaaggcacatttgaggtcaggagttcaagaccagcctggctaacatggtgaaaccccgtctctactaaaaatacaaaaataggccagttgtggtggcaggtgcctctaatcccagttactcgggaggctgaggcaggagaatcccttgagcctgggaggtggaatatatataccaacctaaatgcttagtatgattacaaggcatgtcaataatttcccccatgagtagaaatttactttctaatttagatttttagaacactttgaacataaaatcaagaagcttaattttatatggaaaagaacttttaatgaaaaggagaaaaaaggtgaaataagagaataatttttgaccaagaatatcagtaattttgcatatgaatttttaaaatgtttagattatgttaatctagtaatatttagagataactatgaaaagagtcattcatatttagacttgcaaattctagcaaatttgtgtctgaaagatggactgctagagccccctagctgctggaaagaattctgtcctcctaggtatagataaataacctaattgcaaaggcagtaagtagcacaccaagaaatctagtggaacacaattaaacaagagcatacaacatgatcctccactactgtcccacctttcaggctggtggcaatgtcagcgcagctgtgagcatccacagacatctgtcctgggcccccacccccatcaccctgagcttcttgacagatcaattgtaaggacaccattatcaccctattgttctgattggtttgaactagatggtctctcaaactcagaagtgcaatgagttcaatcaagttagacatttcaattccatttttggtagaaggagagtctatcccaggaacctggaaagttctgagccttgggatgaatgagaggctacaaactctcagcccatggacaaatgtgttttgtttggtttgcacagagcttttaaaacctttaaatagcttacatagttctctttaaaggcaatttacacactggaaattttttgatgaaaattcatatttccagcttctcttgaaaaatcaaaagatctggtaactcgggacccgagtactcatatagtactgataggctaagtagtggtgatctactttatatgatgaataaaagtttagtccaccacagttcccaccacttcatattggataatataaaaccagcatgctgaatgcaattacataacctgcttggagcctgtaggcaactatgtctgtaactcctagtctaaactgtaaataattttattcctcctcctactactaataatagtcaagcttctagtgattaaacacttactatgagtcaggcacagtggcaggtcttttgtgtgcagtgtctcaagtcttcatatcaagcattcaagacaattatttattttgtaaacaaaaatatgagatttatgttcaaattaaataattcaaaaaatatataaaaagcaccaccctggccgggcgcggtggctcacgcctgtaatcccagcgctttgggaggcc

SEQ ID NO: 1399 - DNA, 2470 bp, Homo sapiens
agctactcgggaggctgaggcaggagaatcgcttgaacccaggaagcggaggttgcagtgagccaagattgcgccactgcactccagcctgggcaacaagagctaaactccatctaaaaaaaaataaaaaataaaataaacctagttatgaaataatgtatattatttataataagctgcaaaaatgtgtgggattaaatagcatctgattcaggttaaaagaggtcatctgcggtgtggaaggcaggaggtggctggtgtaggaacactggtggttttaatgcgtatgcaatgttttatttcttatgctgggtgataggtttgtacttacttattatatttgttcttaaaccttttagtatcttgaataaagtatagcctttttgttttaagaaagacaggtaagaaggagaaaaaaacaaaaaaaaaaaaggaaaagggaatatgttaaaatcagaaacagattcaccttctctaactgctgaattgttcagacgcagagcaatggagtattctctgcagcagaggagcgtctgcctatgtccacacctccggacagtacccgtaaacttaggcatttgtgcaaatccactccaacagtgaacgttgcctgcaatacacagcagaccagactcatcccggcggggtgatgaagcacacataaaccccattatccagctatttcagctacttggcttctggaaactaacaacgactcctctctttttttcactgtcgtcttgaaaagtctacacagggattgccccgcctgctgaaactctaacaggtggcacaagaacgttcactcggagtctatttagagcataagctgctatttacctttgtccacactatttactccataccggctgagaaagaattttgatgtcaaagactgacacctgaattccatcaattttcccattttctttctgggccaaccatgtccaattggcctgtgcaagcagtcgaggaggggactgtgatggcggccccgctctagccagtctgctctccacgttttcatcctgagagcgcagctggtagatctatttccagggcatcctgcagcgggcgcgtgagtcacgaaatcagtcacacaaatgacccaccacatataaaaaagccaccaatacatcaacaggccttaaaacagagcagcagttgcaatagctcctagatcagcggcagtaagcagcagaggcggcccagcacagaacccgggagcaggccaggcgggcgctgtgctgctgatttatgcctccacttcattctctattcaaggtatgaaactttctgaacagcagatgctaaaaaatgaaaaaagattgccataacaatatgaaagcagggtgccgggctatcaagagaggaatatttatgtccctagggagatcattctcacaacatcttatccatgtgtcatctggcagggcatgcgggacgggcggatggtgggagaagtggccacttcgccccctgcagcacatcagtgagagccagtcctgctccaatcggaggtccccttgtcataggcctgtccccaacatgtacaggacccctccatttgatgtcactgaaggagttgatcaatagttctcttagacttggcatctgaagaccggtttcaagtcccagctatgccttttagctgtgtgacattgggccagccatttgccctttctgagcctcggtttccccatctgtacaatagattcagtgatccttggctcacaacgagatggagacctggatacaaacatgctctgaaaacggaacgtgcccagggagccatgggaggaccacacacagaggactgaagagcaaattctccctcctctttttgcaaacctgttgacctggagaggctctgctggaggccaggaggagggagggtgatggagcactgagaattagcagcactggggcatctggccatgtctagaccatcaggagagggggttgcttcgggctccaggtagagcctcatgctggatcctttccagctagactccaggggtatcgggggacagagtggcagctgtgagttgaattgtgtctccctgaaagatctgttcaagtcctaatctcgatacctgtgaatgtgattttattcgggaatacagtctttgcaaatgtaatcaagttaagttgaggtcatattgggtttgatggtcattaaatcaaataaatgaagtcctttaagagaaaggagagggtgattcagacacagagatacagatatgcagagggaagaccgagaccatgtggagcgaggcagaaagtggggtgatgcatttacaagacaaggattgcaggcaagcaccagaaacgaagagggaagcaaggaaaatcctccccgggagccttcagagagagcatggacccacaggattggacttctggcctccagaaacaacattctgttgtttgaagtccctccatgtctagtaatttgttatggctgccc

SEQ ID NO: 1400 - DNA, 1915 bp, Homo sapiens
agaactggggccagtaattcaaccaactgcacactgtatctcatcttttgcagaaaagggatggaacaaatttggagcacctactttgggccaggactcatttaagcttcaagaaacctaggaaggaggcaacttcccgccatcttataggtggagagactgagggtgaatattgaattgattcacttttgccacataacaaagcactcccagagtgtcctaagatctccatttctttcacttccaatgctataggtaagcagtttgggctggacgcagatggacgcccttctgatgatctcagcgagacactacccactcatggtcagctaggaatcaagtggaggctgactggtctcacccacctgtctggtagttgatggctacgggcaacacgaatggctgagccatgtgctctcatgaacccagcttcccagggcagcaagagagccagccccaatgtgtgaacactttttaaagcctttggtggcttgtttgctaatgtcccaggagccacgtaagacataaggccagtgcagagccagtgtgggaggggactatccaaggggcagatagaggaagttaaacaaattatggccgtttttgtaatctgcaacaagaactccgttcaaggaacacactaaatgcatggcagagcttcctctttgatcttctgagctgacaggcatgtggtgagcacagcctcatgtgtccctaatgtgttccagacacacttagcacttcccacacagccatgtaaactgcccggtcctcaccgaactttctactccgactgatcttgagaggcacgtgtctcaggatttaaataaaaatgaacaaataaatgtatttataaagcctttggaaaaacagtgtaaatgacttagaaacaaaatttattttcagaggaagaaatcttgtttatgtgattctagattaattctcagaaagcatttttataatggaagcagggaattctataggtctctggcctcatgtccacagcagcgcatcagtttctcaaggtattgctgggcttggtttccaaagaagtgccaaggagtcactgagggtgcccaggtcttagtaagtgagctttgactctgactctgtagctgtgtttaaacaaattcagccattttgtatcatatatctggaaaagggcaaaatcatttttcaagttggagaggatggagaagaggggaaatgtgtttggtgttattgcaattagtcacgctttggaacatcctggggaaagtcgactctcaagttattattgacatagtgaagtggaggaggttaaaaagaagtctgcaggccccattaattaacctctccattatttttatttccctgtgcatttttctgatggacagaagatcaaggggtcaaaccctgttagagctgcaggcatcccggcattcacaaagcccaagcctcttgctttccagagacaagaggagttgttgtcagtcttcacaatcacagcaggctttcaggtgggcacagatcttgggcccacagcgtttgtgaggcaggtccccttctccacctcatactgtttctccaaatgctgctcatacattgctaatcctcctccaggaagccttcctggatgtatttctacttcctctgtaaccctcagcctttcttggtgcctccttatagtggattctggggcactctgcccagatcccctctttaggaccaaagcatacattcccccagctgtagccctcactggcaattgcatttagccacagggaatagcccagcccaaggtcatagctcttgcagaggcagcctacggctggtgactggctgaagcagggaaaccaagcccagcctacttccctccatttggggacaatgctgaagggtcaccctggcttcagagctcccaccggagcagctg

SEQ ID NO: 1401 - DNA, 1768 bp, Homo sapiens
tcctttttgggatgtcacagatcaccaacttccttctctgtgctgtgtcaatagggacgtcacccctgtggggaaaggaatttgcctgaacaagacactaaaaagataaaataggctgaagcggagaagaataaaagattgtgctggcatgagctagttttgcaaaacccatttaaataaactcaggatattaccgaccccatgcacacattctttccttgactctgcaatgttccgttaaaccagattgtgaatttttttcaggattaacaatttacatttatgattctattttcttttataagtaactgctatttgtaaatgagactaattatttgaattcatggtacaaataacgtaatttagagttacagaactcttgatcctctgggtctaagcaaaataaacgtagtacctaatgctggaatagagcaagagttttctttgaatctcaaaatatctgcattgtgaaactgggttaagttattttggaaactataaatagtcacttggtaattaggtgtttggttttatttgttctaatggagtgcttattacagtcggtgcatttttaccccacggatcagaagcttttataggccaagtgatgagagaccatcttctacatttcatttgctgattgtgactcatcactgatgatcgatggactgctgaactttttaattcctgtttgcttgtagagaaagaaaattctcatctcttttgataggtcctactccaaaattctgcagccgttttgtacaatcataaccttacacgatatcacacaaaggcagagaaacgattgcatggacatgccttcctgtcaaacgtgtatggaatctggcccgtcctaggcttatctctttccaccaggattcttcttcccatttttctcagcagagcatcttcacgtagttcacatgacatcagaacttcatcaggatgtaagttcctgcagaaataggcctgtgtctggtcagtaaacagagaatgtaatgacattcccagagcattcacaggccagagtctggtgtcctccccagcgtccagcaggctgcggatggatggcatgcagctgacaagattgatactgcattagacattcctggaggtccctgcggctggggactggcactcgcaggcctccccctgcacacagctgtctttggagagcacagagcaatgggaggcggttttgttttactatttgccatttagagtctcacttttaatttatcctcactctttaagaaataattggtaatttatttcttagagatcaaatgttgctacaagctgaaaactgttttataaatatttcaggaaacttgaatgcctggaattttcatcgtcacgcttaagtcttcctccaaaaggggatggacttcgttccatcccgctccaaaagctggtccgattcttgcctgggtgttgtatgctatttgccttttccataggctccaataacaataagtacatcttaaaattgatgaaagtttaatgaatggctagcaagcagagagactacttttataacaagattaataccttggctcaggggacataacattttagtaaaatcaaaatttgtatagttatcctagcggtgcttgcaacctctggcttccatataaaaatgtctaaataaaatactggcagccgtctctagccattatttccatctgctctaggtggcctgacccggaacccactcagggtggtgcactctgggccggggtctctgggatttctgtcgcatcagctt

SEQ ID NO: 1402 - DNA, 6338 bp, Homo sapiens
ccaggtgtctctgctaagacctccgtgttggcgggggagggcaagagcttaaagccacctccacgctctgactcagttcccagggaattcccgctccaagcctttcccaactccatgacttcagggcccctaaaactgcaggagccttttgttcagggctccctgacagcgtgagggtcccacgtctgtgtagatcactctggctctagacctgtgtgctggtcagtgagggaaagagaacggggagtcgacatgtcctccgacttcagactcttgcctgtcccagccgagcccttaattaagaagacaggaccaaacttcacaatcctggtgagaagccaccgagtccattttttttaacgaactcaatctgttgtttgaaatgaagatggcctttcataatgagtgaaaaagcgactgatggtgttttacaaggaacagatactaaggtgagagtggtttgtatatggaagtgagaaaatgtgtttaccaccatgtgattttgttgcaaaaaatcatgggtcaactaaacagaaaaataaataaggaaactttcttatctgtctctttaagaaaaataaacttgaaaatatactttttaacctgctctgagatcatatgaaattttaacactctgattcattcacaaagtcagctgaatgatatcagtgaagacagaaagttaatcatatcaacagaatgatttacatcattggtagatgagatcgaaagaagaggtcctggtattatcataaaacttctgcccagctccaggcccttgtgaagggtgaagttcagtcatgataaccatcggaattgagtaccagcaaacctcagagataacgtgggttcagtaccagaccaccacaataacgcaaatattgcgataaagagagtcaagtgaattttttggttttccaatgcatacaaaagttatgtttacactatagtgtagtctgttaaatgtgcaatagtattatgtctaaaaaatgtacatccctaaatttaaaaatagtttattgctaaaaaatattagagatcatctgagccttcagcaaactgtaactcttttgccagtggagggtcttgcctcgatgttgatggccgctgactgatcaggatggtggttgctgaaggctggggtggctgtgccaatttcacaaaagaagacaacagcaacgcttgctacattgatggactcttcctttcaggaaagatgtctctgtagcatgcaatgctgtttgacagcattttagccgcagtagaactttcaaaattggagtcaatcccctcaaaccctgctgctgctttatcaactcagtctatgtaatattctaaatcctttgttattatttcaacaatgtttacaacatcttcaccaggagtagattccatctcaagaaaccactttctatgttcactcgtaagaagtaactccttatgcgttaaagttgtatttgagatttcagcaattcagtcacatcttcaagctccacttccacttctagttctcttgctgtttccaccacatcagcagttacttcctccaaagacgtcttgaaacccctgaaatcattcatgagagttgaaatcagcttctttcaaactcctgttaatgttgatattttgtcctcttcctatgaattatgaatgttcacggctgcagaatggatgttgtgttagcaggcacgaaaacaattcatctcatccccatgtgaccaggtgcgttgtcaatgagtaaaaatgttacgagatctttggggtgttgcttttctggctggaaacctctgtggccagtggcaccttggtctgacttcttgagtccagaaagaatgaggtacacagacaagtggagggtgagcaagacaaagaggagctttattaagtgttagaacagctcagaggctctcagcagagaggaggccctggaatgggtggctcctctctgcaggcaggtcatcctgatgagtgttcagctctcagcagagagggtagcttctgctgcagctggtcaactggacatctgtagttctcagcagagaggaggccttggagagggtagctcctctctgtggctggtcgtccctacatctgctgctctctgcagctgataactcctctctgcagctggtcatcctggcacctctctgtcctctgctctgctctggctgagtcttttatggcttttatgggcctcagaggggaggaagtgccttccaattggtccatgggtggccatgagagggcctggaaaaggcacaagtccctactccagtccagaggactggcaaccggcccccagccttcaggtcctccctggcctgaaggtgcatcctcatctggaacccactccttcacacccaggagcccgtctgcctcctgccaccactcatcatgcccaggccgcttgcacccaggggtacccgcaggccagtgctgagttgccaccagccccgtctcagcctcccacctgcgctcattggtgcccaaagtccagagaatctgaggcagcagggcactgcacatgagcactgccctgagtgtgcacacacctggctggactgcaacagcacccaggcttggccccaaccctactctaggatcggagtaagcactggaagcagggagaggccaggcagcaggagcagatacccccaagcctaagccctgagagcatcgggaggcccaggcccacagctgcaacctgggtggctgcaactgagcctcggcagctcccacactgccaacttgaggggggtcatggctcctgcctgtcccagctctgcaaagtgagcagacctggctgtgcccttctctgcgtctccctctgccgcagtggtggcccttgcacaagtgaacccgatgttcctggggctggtcccatgagtcctggctgcaactttggccgggtgcttatgggctcccaggacatggcagagtgtgaggttgaagctgtggcagaggctccaagcctcggagcaggtcctgcccagccatgcaagggtggaggtggcacagttggctgccttggggacatggggcacagggaaccccactgctgctcccaccaccagtcctgctgccctgtccacctccttgcagacttcggtgggggctccagggccttgccaggcccgtgccagagtcgagggcaagggtgatgttgccacaagttccccgggggccctagtgctcaggggtggtccagggctcccctttgcccagctcacaaccctgccagggttggctcctctgggagcgaattgcaggccctgggcccagctgccaggagtgccaggctcagcagtgggagcagtcacttctgagcctgtggggggcagggagggattcccagtcccctaagaccacgggaatgccctgctccatagccggccttgagcagctgcagtggtgcccagggagggctgggctcctgcctgctctgtggagtggaagacccagctgcacctccctgctgcagctggcatcttggaagcagccactctagatggactgctgctgccattcataatattttgataggaatcttttttatttttattttttctgaacagtaggtctcaataatgggctttaaatactcagcaaaccatgctagaaacagatgtgctgtcacccaggctttgctgttccatttatagcacacaggcagagtagatttagcatcgttcttgagggccttaggattttttgaattgtaaattagtcttgccttcaacttaaagtcacaagctgcactggcccctaaccagatagtcatcagtcctttgaagttttgaagcccatcactgacttctcctctatagctataaaagtcctagacggcatcttcttccaatagatggctgtttcatctgcattgcaaatctcttctgtagtgtagccaccttcatcgacgctcttagctaggtcttctggataactgggtgcagcttcttcatcagcacttgctgcttcaccttacacttttatgttatggagacagtttctgtccttaaacctcatgcatcacctctgttagcttcaaacttttcttctgctgcttcctcacctctctcagccttcacagagttgaagacagttaggagcttgctctggattaggctttggcttaatggaatgttgtgcctggtttgatcttccatccacaccattaaaattttccccacatcagcagtgaggctgtttcactttatctttttattgttgttgttcactggagtagcacttttgatttccttcaaaaacttttccttagcattcacaactcagctaacttgttggtgcatgacacctagttttcagcctataatagctttcaacacgccttcttcactcagcttaattattgctagcttttgatttaaagtgaaacatgccactcttcttttcatttgaaaatgtagtcgccattgtaagggattaattgatacaatttctatttgtttgtttgtttgttttttcatatggagtctcactctgtcacccaagttggagtgcagtggcatgatctcggctcactgcaacctccgcctcccaggttcaagtgattctcctgcctcagactcccgagtagctgggataacaggtgcctgccaccatgcctggctcatttttgtattttcagtagagacagggttttgccatgttggctaggctgctctcaaactcctgacctcaagtgatctgcccgtctcaacctcccaaagtgctgggattataggcatgagctactgagcccagcctcaattgatctaatttcaatattgctatgtctcagggaagagggaggcccaaggagagggagaaggatggggaaaggctggttggtggagcagttagaacacacaggacattgatagattaacctccccatcttatacaggtgaagtttgtggctccccaaaacaatcacaatagtagcatcgattatcactgatcatagatcaccacaacagacgtaacaatacttaaaaactttgaaacactgagagttcccagaatgtaacagagacatgaagtgagcacacgctgctgggaaaacggcacccacagacttgttcccacctggggttgccacaaaccttcaacttgtaaaaacacactatcagcaaggcacaagaaagggacgcacaataaagagaagtgtgcctgtgcctactgggcaggtgaagcctcgcaccaaacccgcaacccacagagagcccacggagcacggcaaccccacgtgcacatcacaaaggcaagaggagcgcacttcaggaggatatccaaatccgtttactgataaacatgcaacggtaacacaaggagcccagtgttgggaagaagaggtgtgggttgctttgtgttttccttcctatgtccttctctgcaccccacagtcagacatttatgaagccagatggcacctggctctgggactggaaagatgatataacgtgggcacccaggcaaacagaagagtgcctttgggtaggagttgcctgaggatacaagccaggaagggcgcaaagccagccagagcctggggacgctagctgctcccctcggagacgcctcctgagctgagtttgaagagcagcaggcactcaatacactgcatggacggataaataccataactaactttccccaaaggaccacagggaatcccgtagttgagtaaataaacagtgagataagacaggtccagccaaagaaaactgctaagccagctcagagataagccagaaatgctatcccacaaggatggcttataaaaatcaatattttaagcaaaacagtaattaaccatgtgcttcccttgagggcaggttgaggagagggtgcggagccaacatctccagaaaacccacatgtgcttgatgcccagccccgcatggctgctgccgttgctggcgtttgcattgttattgccactcctaccttcttctctgattatcaaacttgcaaaagagttttggttgcatgttttttttcaaacacttcctttaatatccacatgcaggcaaatgtccattgtccctgtgtgtcgtgggagatatcaggcttggcgaggtttgtcgaacctgcacaaaggcccgcggtgatgatggtgccgacgttcctgttccagtgtatctggcctgaatcccaccctgccaggctggggccaggccccctccccacactggctgaagtcgtgcctcatccatctgacgcatctgagaggaacagggcttcccagagactctcctgggcctcactaggtcccaccctggggccgagtgcactgaggcatttggctgggctccacatcgtgacttcctgaagac

SEQ ID NO: 1403 - DNA, 1165 bp, Homo sapiens
gctgctcatatacaaataagaatgtgtgcaaaccaataagaacaaaatgaccatcacccctccccaaaaaaaggggcaaagaaaaaaccattcacaggcagaaaataactacaaatggttaataaacataagaagatcaacttgcctaatttagaagcaactgaagacaagaccttccaatgacagccagtgccaggcacccccagccgagaagctcctcagaacattgagaatgtaaaatgggaatttatctcaagtattcaaactcggaatgactatgaataataaacctgaatgaagcattgctcataaaagaaaatgctggaaactgcctaacactcgcagggtctccttagcaagtcctgctatgcagtcatcaaagagggagaagagcccagtgggcagggacctggaggtcagcgccagggctgcgaggcacccgggaggtgagagccagggctgcgggggggacccgggaggtcagagccagggctgcggcggggacccgggaggtcagagccagggctgcgggggggacccgggaggtcagagccagggctgcgggggggacccgggaggtcagagccagggctgcgggggggacccgggaggtcagagccagggctgcgggggacccgggaggtcagagccagggctgcagggggacccgggaggtcagagccagggctgcgggggggacccgggaggtcagagccagggctgcgggggggacccgggaggtcagagccagggctgcgggggacccgggaggtcagagccagggctgcgggggacccgggaggtcagagccagggctgcgggggacccgggaggtcagagccagggctgcgggggacccgggaggtcagagccagggctgtggggggacccgggaggtgagagccagggctgcggggggacccgggaggtgagagccagggctgcggggggacccgggaggtgagagccagggctgcgggggacccgggaggtgagagccaggcttgccgggggacccgggaggtcagagccaggcttgccgggggacccggaaggtcagagccaggcttgctgggggacagctggaaggtacacacctccagagctttaggggtaagcctgtgtattttactttctttatatttctccgaattgttggaatttt

SEQ ID NO: 1404 - DNA, 2041 bp, Homo sapiens
aataactgttaaatatcggtgtccccttctaaggatgtaagcctcgcatggcataaggactgcatctgttttgtttgctgctgcacttgcagcactgatatggcatttggcacatagtaggcattcaacaaatgaatgaactccccagctcaatctcagacctgaactggacatctccacttgaatgccgcatagctatctcaaacatctgcaaaagtgaattcatcaacttaaacctgggcctgctcctgaatggcaacaccatctacccagtccacaaagtcctgccattcttgacatttgacgatttagcaaaatctgccattcttgcttccttaatatctctagaatctgctggtgtcctagtttggtccttaacatctctctcctataccatggtatctgaaagtagatccctgacttcagggatctcacagtctagtgggggagaaagacttaaaccaaaataaaacaaaacaaaaccagacaaaaacaaaaacaaaccagtgattccagtaaagtatgaaaagtactatagcaaaaggctgagggaactgagaagaatgtgatttaacattctgcctaagggaatgagggagttttcacagaagagctgataaaactggaagcttagacaattacacaaggacataatatatacaaatcaaattattaattcagaatcacaaaatgttttttgtcttctgtcaactgatgctggttccactcagtgaggtctgcctcatcctccaccatagaagtgtccaaaagagaaaacggtcatgtcgtgaggaccccaatccccatgtactgagaggaggagggggatcagacctcatcagggagcccagcccatgccagccctaaggactccagagtaagagaagcagaaattcaacttagaaatctgagccaggctcctagcagtggcgacatagagggcaggtggaagtagaagcaagaggaggactgctatagaagtagcaggtgtttggaagagagtggagctataccaggtgttccctctcaattccccactctgaaacaatggggaggccaggtgcagtggctcatgcctgtaatcccagcactttcagaggccaaggcaggaggatagcttgagcctaggagttccagaccagcccaaacaatatagtgaaaccccgtctttactaaaaataaaaataaaataaaataaattagccaggtatagtggcatgcgcctgtagtcccagctactcgggaggctgaagtaggaggattgcttgagcacaggaggtcaaggctgcagtgagctgtgatcatagcactgtactccagcctggacaacagagaccctgtctcaaaaaaaaaaaaaaaaactatgaggaagttcagccccctcaccaggacagacaaagtggcacttgtttttctgtgcatgtgagcagtgagcacacctgtgtgtgtgcacaacagagaaggggtcccaaatctcaacttttatgccaggaagcattcccagcctagggagttggaaaggagctggaaggtgtaactgagtagggaactgagcaccacctcattactcccccgcaatcccctcctcactatccaggctgggcccaaatgccttcctgtgctgcacagggcctctccattcctctgctcttagaaatagggtaggagtaaaggacgactggacagaactgggaatatggccacagaagagtcccttgcacttttagactgttaggtgaaaagcaggggtcagagagtagccgtcactgagggaaaggaccttagcagagctggatcgatgacatgagtactcaagcagggtcaggaagtttaaacgtataggtgtttagaagtaaggatcttcagcgaaaagttttgctacccagtaaaatgtttcgaagaagtaaagtgcatggtagttagaaacaatcccctataggataaaatcaaaattccacactccatctccaaaaccaattacaatctgacctcagctacccctggcttctaatagtaatctacctccaggcctgctgggctc

SEQ ID NO: 1405 - DNA, 2143 bp, Homo sapiens
gaccttgttcaacttgataaaataccctatagctaccatcatacctatggtgagcaactggatgtatttctcctaatatcagcaatagtgcgataatgtcttctcttacttctcctagtcaatactatgctggagtatctagttagtgcattaaggtaagaaaagaaaagaaaactcagtttacatgcttgatgttcttctcaaacacccatgaaatcagtctaattatgagaaaaacatcaggcacatgctaatggagtaatattctataaaacatttgaagattactcaatactattgaggtaatcaaaaacaatgccagagaaaagtatagccaagaaaagcccaagaagacatgactatttcatgtaatgtggtaacttagatgatattctggaacagagaaaggatacgaagaaaaaactaagcaaagctaaataaactatagcctttagttaaaaaaaataaacaagtcatattttatatatatgctgttacttatattttataatacctggctggtgcttagccttgcctctctgaaaatcttggttctagaagtgcataaaaggaaagagaggatcttttttaaaatttattttatcattctaagtattattattattattattaagagacagggtctcactttgtcacccaggctgaagtgcagtggtgtgattatagctcactgcaacctcagactcctgggctcaagtgatcctcctgcctcaaccttccaaagcactgggattacaggagtgagccaacacacctaagaggatcttttctacctaaatttatgctagtcaacagtataagcagtaacaaactttaaaccaaatagaatgaaaaaaaaccacaaaaactccagagcttaggtaaggaaattcttatctaagtgggttggcttagctagcatgaattctgcctaaaatcccaacacttcccacatttccacctcaagtattgcagcctgtgccctcagggtaacagatcatcaaagctgtgtttttgctcttcactttctcttctctgtgtgtattgactcatcttttaccacttccacaaccccactactcagccctgatgctctaatatatcaaagccaagtttataatcaaagaatcatacaactaccattgacatcatgacccacgttagtatctgtttttcaggaagtgttgagatcaaagaagtagatatgtttggtcacctcccagctcagaaaaatctccaaattcacggaagccctgcagtaaaaaagcctgtttaagttaatttaatgcctacatgaccagatttattttgacagaatacaccctcttccacacccacccagcatttgttgttttttttctagttaagggacactagccttctttggaacacaatttggaaaatgtgaacgtcccctgtctggtacatggctctatctcttctacattcttggttttctaagaaaagctgcccaggatctcttaccctactgtactcccctaaattttctattttaggaaatacagtgttataacaaaaacagtcagaatatggactgtgatgatctttgccaaatacagagtcatctcattaaacctcagaggtagtgcctcagtagggcctgagaatgtggcactataaaattttcacttaacattaaaacacccaaaaaatatctggggtaagagcagatgtctttttgttttgtgcaatagcttatatggaaacctacttataggtgggccattgtttgcaatattttatttaaataaatttgttgtttgggacactaccttttaatatactctctttcataaactaagtttggtcttctggaaatgctgtataatattgagaataatttacatccaggaaaaatgtcttgtttgaagaacctcgagtgacttctcatttcaaaatatatcaagttgtttattcttaaaggctcaaaggaatctgaccatgtgtattagtccattttcatactgctatgaagaaatacccaggactaggcaatttataaagaaaaaggggtttaatggactcacagttccatatggctggagaggcctcacaatcatggcagaaggtgaatgaggaacaaagtgacatcttacatggtggcaggcaagagagcatgtac

SEQ ID NO: 1406 - DNA, 1619 bp, Homo sapiens
ccggctaattttttgtatttttagtagagacagggtttcactgtgttagccaggatggtctcgatctcctgaccttgtgatctgaccgcctcggcctcccaaagtgttgggattacaggagtgagccaccatgcctggccgccatcttattttcttctggagtctcgctgttttgcccaggctggagtgcagcggtgcaatcttggctcactgcaacctccgcctcccgagttcaagggattctcctgcctcagcctcctgagtagctgggactataggtgtgcaccaccacgcctggctaatttttgtatttttagtagagacggggtttcaccatgttggccaggctggtcttgaactcctggcctcaagtgatctgcccccctcagcctaccaaagtgctgggattacaggcatgagccaccgcacccagcctccaacttattttctgagaaggaaaaaaaattaagcaagggacaaagtatggaattttactaagcctgagaggcagcatgatgttgtaaaaagagaacaagttttagagtcagacaggcttgaggtcaattctgactctgccttcacctatcaattttatctaacatttatttggtgctgatattgtgccagacattgttccaagccaacactactcaaagtgtggcctgtgtgccaccagcatcagcaccacctggggacttgttagaaatgcacattaatgaaataagccaggcatggaaagacaaataccgtgtatgacctcacttatatgtgggatctaaaaaggtcaaactcatagaagaacagagtagagaggtagttaccagaggttttgggagggagaggagagatggaagaagagctgttggtcaaaggatgcaaagtttcagttaggaggaataagttctggtgacctactgcacagcatggtgacaatggttaataataatgtatatttcaaaattactaaaagtagatattaaatgttcttaccaccaaaaaggataagcaggtaaggtgatgaatgtcaattggtttgatgtaatcatttcataatgtatacatatattaaaacatcacatctaccccatacatataattattgtcaattaaaaataagatatatttttaaaatgctggttatcagccccacctcagacctacctaatcagaaactctggggatggtgcccaggcatcagtgtcttaacaagccctccaggagattctagtgctctgtaaggtttgagaaactgttctaattgttttaaaactcaactcatttaatcactttagctatatgacctcaggcaagtatcatccaggccctctaagtctcaccttccttattacaaaatggggatagtaagaaccacttagaaaattgctgtgaggatttgaaatagttgtcattcaaataaagctatctttgccattacagtagataattttaagatctcttcaacctacttgtcgtgcctgccaagtgagtcggcctgccactaggtggcagggtttgctatcgatctcccaaagttagacacaaatgtgcctctgagacggggcagtgcctgaatcctcaaaacagaggtggtagcggtggcagaaaccaggctggaggct

SEQ ID NO: 1407 - DNA, 2577 bp, Homo sapiens
agggcgtacactctgatccaaacgtggctccagccaaggaaaccaacaggcatttcacagagagactcacagttaggggttccattcattagggttaaggatgccaagagtacatgagataccatttcgtgggtacagggagttttcaaatgaagtacttcagacactcaggcatctgcccctatactggtgatgagcgtagggatcaaggatgagaatgtgaactttaataattcttgccatcctaaatatgtgtcaagagccttttaaaagtctgtatcttttcatccaggaatcctaatcctagaaatccttcctgagaaaataatcagagatttgaccaaagatttaagcacaaagatgctgatcatagcataatttttggtagcaaaaacctgggaacaacctaaatttccaaaaataatcacataaattatggcatattcaaataatacaatattatttttaaatgttaaatagttactttataatatttaataatatagataaatgttcctaatataattgtaggtggaaatatgaatataaagcaaacatactatctataatgtctcatatttttaaaaaatacgtgtagaaaaaaatatttaaaatgtactacaatgggccgggcatggtggctcacgcctataatcccaacactttgggaagccaaggtgggtggatcattagaagccaggagttcaagattagcttggccaacataaccaaattccatctctactaacaaagaaatacaaaaaacagccaggcgtggtggtgcgtgcctatagtcccagctacttgggaggctgaggcatgagaattgcttcaacccaggaggcagaggttgcagtgagctgagatcgtgccactggactccagtctgggtgacagagaaagaccttccctcaaaaataataataataataaataaaataaaatgtattacaatggtataagtggttttccctaagttgtgaaattacagatgattttggtgttccacaattctacaataagcatgcacactttctataacatgaaatttaatattatttttaaaaattcctgtcctacctacctcacagaggtagacaaaaaaacaatataaagatgaactttctaacagtaagaactatcctaaaatggaatctttggggagagagttcaagctagcagtatgtgaccacatggcccctgattaggttagactttagagacctggaattctacagccccctgtgaaatatctctacccacaggatatgttaccccatccttcctgcctagtaccctgatgctcagtggtacatactattggggataaagcaagtagtcagtggccaagaaatagagatcctccaggggaacaaccctagcagtcagtggccactatgccatcaccagcttggccactatgccattaccagcttctaacaccacaagtagtaaaagcccctctgtccagcaaacatattgctaggacctctgctactggttctaggacactgtgctcatggacttctctgaggacctaaagtggtccaaaggcttcactttgcagctgtggtcccatatataccatgggaaaggaaaggaggagtcagactgtcaaatacaaccatcagacattttattcttgacccaccattgggtttggcccaccaagtattttaaaagacaatatagtagggatttggcttggtcacaatataatatgagcatcttaacttatacctatatccctgcaagcacctaaagttgagacaggaaaagtgagaggcaaagtgacttgctgaaagccatacagcaagttatcagcaagctaggtttagaacccaagtgtccgggcttccaattccatgtgttacattacagaatccctagctcctcagggaccctagacccctgatattaggaggaccccagacccctgatattaggaaggaccccagactcttctacctcctatggttctctttgcccaagactgcaggacactttagttattaagttgtcagtgactgagacatgaggaaatatgaagttcatacttgtagttaggagtaactgacagcaagcaaacagaaaaagacaggacatccttggaacatatgggtatattgggtactctagacccaaaattttatacaggaagtgaaatagcatctaatgctaagtagatctatgatacaagtgaatatccatattcctcaccagaggagagaggtagagatacttcatgggtatcagaagaggctggagcaatggacaaatgggtgttagaaaaaaatcaattgctaccttggcttcttggtcctccttagcctggctacagatttcctctcatcagagaactattataggatagagcataataaatgtaataaattctgaatgaaagaatgtttattctggactctatttaagatggtgactctatcacctaggaaaggggtgaagaagtctggtgtgttatatttttcctaccattccacattttcatattatcagaaaagaaatgttaaaagattagaaagtggagcaggagtaggaagacaagagtggcagaac

SEQ ID NO: 1408 - DNA, 1822 bp, Homo sapiens
cacacgttcccctgaacgtaaaataaatgttaaaaaataaataaataaaatggtggggaaaaaaaggtaatttcctatggttcaacctaataattctactacaaaaagtaatctgttagctttggagtcctctcccttgctaggggtttctagggaagaacacacacgacctgtcctcacaggggtcccacccacaggccccaacacttgctaaaatctgtgtcccttagagaaagcgttggcaggcattggggaaataactgtttctggggcatcagcccctttaaacctgctgaccaagtcctccgctctcattctgcagtaggaaagtttacaaagatacagcagaaagaacaaagaaaaccaaaaaaggagaaggtactaattgttgagcatttactatgtgccaggcccttagactaagtgttgcatatatatatgcctattgatcctcgaagacaatcttgaaaagtgagcacttcccattttccagagaaggaaacaggcttacagacatgacgtgtcgtgctcacggtcactgagcagtgaaagccagtgtccccttatctgtgacattcacacagctggttatttgggagtatttgatggttttgtgagtatttgatggttttgtgaagcctgagctgactcctcttgtacccatctgcttgactggtacaatcatctccctcacacagatgcagaggtgagccccgaagacattgagccttgcctctcccatcacacgacaaatgaatggcaggaggattgcttcaacagggcatgccagaatcatcccactcagcctggtagcttcattggcacggttgagctggcaacaggacactcatgcagggcaactgaataatcagaagcagtgaagcctgaactctaaccactatcattttaaagattattatgtgcagttatttcagctaattaaaccttgaatgcctgccagctcagcttccagctcagagaggaaatgcaggcatgcatggcctcagcttcccttccagcctctgtctgcctttcagggggagcagagctcagggcctgggaatggagggagcaaggagagcagcagagcaagggaggggccctcaaccactgtggccacttccccatgggaacgcagaagttctgatccttgccacgggaaaaatcccctgacttttgtagcctctcaggtatgggaagttacagcctgttctttactggttcatcaaggaagagtcgggtctggcttgaagcctggaatcaatgccaagagcaaagttgaggtcccagctttgtggctggtagctgtgaggacctggacaatcttctgttttctcacctgcatgctctctgaaatttagcttttgcacaaaaatgtgtagacagggtacctagtgctgtgcctatccaatacagtagctacaagccacatggagcagtttaaatttcaatttcaatcaattaaaattaaattagattaaaaattccatttctctgtcacactaggcaatttcaagtgctcagcaagcctactgtattggacagggcagctacagagcatctccatcatcacaggatgttccaagggacagcactggccctgtgattgagggtgtgaaccctgattcgactcaaggctgcaatcccagctccaccgcttactggtgaccctgggcaagttactgaacctcctcatcctcagtttcctcatctataaaatgggaaataacaggatccagcccagagtttttgtaaagattaaatgagaaatgtgtgtaagatacttagaagaatgccaataatggtaagcacactataaata

SEQ ID NO: 1409 - DNA, 2016 bp, Homo sapiens
tattagaatatcacacatcttagcctaatctcttcacaggggataggaaaactgaggccctacaggctaaatgccctgcccatagtcatacaggtcagtggtgtctgcaggaaaataatccaaatctgaggaggcacagttaaaacctagttcttagaacataagactagggccgggggtgcagtggcttacgcctgtaatcccagcactttgggaggctgaggtgggtggatcacgaggtcaggagtttgagaccagcctggccaatatggtgaaaccccatctctactaaaaatacaaaaattagctgggcgtggtggcacatgcctgtagtcccagctactcgggaggctgaggcaggacaattgcctgaacccaggaggcagaggttatagttagccgagatcgtgccactgcactccagcctgggcaacagagtgagactccgtctcaaaaagaaaaaagactatggagggcggtggggagaaacaaaaattcagaagttgcatttgatgacaaggataaataagggggacatgaacaaggagggcatttcagttggtgagaattattctagcacaagcactaaggtagaagagggaagcaggctgcccaagtacaaagggaaatctagtctgaccggagcctgtgtgagccatgcttcagagcttcataagggttcagaaaaatgcagggagcatccttccttcacccctcctcaaatcagatgacactgctattcattatatgtgacacagcagtggttctatactagggaggcttcccaagccagaaagcaagaggttatcctggacgcctgcctgtctggctccctccctctctcctccattatttctccacttccaattaacaagtactaattctcttgcttttatttttttcaaaaagaagttcattaaagagcaaagagttcaaactgaaaagtcaagtccctcttcttttggacatctttttaggtgtcataggtatacaaatttcttaagttccttgaatctattccctttactctctctaccattgccttaattcaaggcctttcaacttttatttggtcagttgacagtctaactagcctccatgcctccagtgttaccttttctaatccaacagagtactctatgtaccatggaaatcaggtccctgttatcacctacttataaacccctcagtggttccctattgctaatagcccacaagtctgcaagttctggcctctggggtcctctctaggctattttctaaccataatgggttatcacaaactttaacaacactaaaatgagtgtagttccccaaaacagcaccctgtttcgtgcacagaatacctttccctctctttgcccaagtccatatctcctcatccataaagagggaaataacagtacttatctcacggctattgtgagaattaaattaattaatacaagtaaagcacttagaacaatgatttggcatcagtaagcactcaataaaatgctacgttaataataacagcaataggaggaagaaacagaggaggaggagtaactaataactgacaagaagaaaaacagcttctagccctcgtcctttggtgacataattcggacatcagcacctccagaaaggctgttgtgaccactactcacaatggcactatgtgcccccacagcatttagtccttaaacatttacaaagaatttattacataccacaactgggtggacagaaaaagagattcagtgcatgcctctactgttgcccttccttccctacaatggagcactgtgtgcctgccacccctaccacactgagagaggaggcgtcacctccatgaggcctgcatatagcatagtgtgtggcattgcagcactcaataaagacaaactaaaattagactttagtctcatagataattccaaaacacaggacaaaattgagcacactcctacattcattctcaaggtaggttttcaacacagaacatatttatttgtccttaccaggtcaaggcct

SEQ ID NO: 1410 - DNA, 4152 bp, Homo sapiens
agagagagagataccatggaacaaaacccagcttggcctcttatacactacataatctcagaaaagtgattctatgctaagagtccagattttaaagtcacacaagcctgggtttgaattctgcctcttccacttactaggtctataatttagggtggtcctcaacctcttaggatttcagattttgtgttgatacaattagaatagtagcgcagacttcaaaaatttataatgaatgttaaatgagataatacaagaaaattgtttagcacaatgtctgatctatagtaataactcactatacaaaaggctgctacaaagatgattatgataacgctgcccataatgtcacttctcattactggtcccagtttccttacttgtaaaaaggaagtaatacaggtaccctacttcaggtgctcactgccaagtcagtccctttatgctaggtgggagcaagacatggacttccatttttctctcttaaaagaccctgccaccagacttgagagctgtagggccaagaagagccccaaacctttgcagttgctcatagagacatcagaaaggcatgtgtttgaatctaggcttagccctctgctgccactgtaattttggcaagctacttgaattatctgactttctatttccttccttggcatatgctcctagggtagtttgttcctggtgtagtgtaaagccacctggctttgctatcaaagagactggtgtttggtcagtggctggctgtgtatttttgggtaagttactcgacttctctgatcctcagtttccttatgaggtttttgtgtagattaaattgaaatgatgtatttgaaagcacctggtgcaatacatgatcagtgctgttatcagatggaattcactctctgtctgctgccgtttcactttcctggcctttacaatatagcctgcattgccctaatcgcagagtagctgtgccacagttacatgttggtcccacaagtgatgggctccaggtagtgaaccaacaatagtacgtggcactcagatgctgcccaagcaatgcttgctgaattgaattttgctagctcttatttttgtatctgtagggggcaagatttcatatgtcttaagtgcaattctgtagcctggattcaaattccagttctgccacttactacacgggcaatttcaggcacattaatgaacctctctgtgcctcaatctcctcatttgtaaaataaggataataacagcaacttactcatagggttctaatgaggtttaaataaattaataattgtaaagggcttacaacagtgtctagcgtgcaacaggaatgttttgttcaataaaatttattcaccatcttcagaaaaaaggagggggaaggtgataatattcatactcttcatctcatggtttcatttgggatgattaaatgacattatcaatagagaaacatttttgaaaaggatataaagtcatacactgatgttatccattataagatttaaaaaattttccagatcagcactactaggtaaattatactcaagaaacaggctagaaagaaattaatgattgaaaaataacatcaacctaataaatgtacgtttttaaattacattaaaataagtacatgggtactctttgtggggtagaattgtaagtgatttttatgtttttctaaatgttcccacctttctacaataaaaggtattacttttacaaatacttaaaggaataaaagtaactattttgaaaataattaaaatcctaaaaagaaaatttggcagaaatgtatttacagctatacattatatgtatataatatatattatatatatgaggtggagctactgcacccttcataaaaagtagaatgtaaataaatatcaaccttgcagtcactaatcaaacttattttccaggtcagctatactctggttgttaagatggttctcttccaaaataagagagaaatagctaattcaagaatgattaccagcaggtggaaaattattcaggaggaatagcattgagaatgttcttctggagaaaaatgatgagctaattgaacaaacaaatagagagagagataccatggaacaaaacccagcttggcctcttatacactacataatctcagaaaagtgattctatgctaagagtccagattttaaagtcacacaagcctgggtttgaattctgcctcttccacttactaggtctataatttagggtggtcctcaacctcttaggatttcagattttgtgttgatacaattagaatagtagcgcagacttcaaaaatttataatgaatgttaaatgagataatacaagaaaattgtttagcacaatgtctgatctatagtaataactcactatacaaaaggctgctacaaagatgattatgataacgctgcccataatgtcacttctcattactggtcccagtttccttacttgtaaaaaggaagtaatacaggtaccctacttcaggtgctcactgccaagtcagtccctttatgctaggtgggagcaagacatggacttccatttttctctcttaaaagaccctgccaccagacttgagagctgtagggccaagaagagccccaaacctttgcagttgctcatagagacatcagaaaggcatgtgtttgaatctaggcttagccctctgctgccactgtaattttggcaagctacttgaattatctgactttctatttccttccttggcatatgctcctagggtagtttgttcctggtgtagtgtaaagccacctggctttgctatcaaagagactggtgtttggtcagtggctggctgtgtatttttgggtaagttactcgacttctctgatcctcagtttccttatgaggtttttgtgtagattaaattgaaatgatgtatttgaaagcacctggtgcaatacatgatcagtgctgttatcagatggaattcactctctgtctgctgccgtttcactttcctggcctttacaatatagcctgcattgccctaatcgcagagtagctgtgccacagttacatgttggtcccacaagtgatgggctccaggtagtgaaccaacaatagtacgtggcactcagatgctgcccaagcaatgcttgctgaattgaattttgctagctcttatttttgtatctgtagggggcaagatttcatatgtcttaagtgcaattctgtagcctggattcaaattccagttctgccacttactacacgggcaatttcaggcacattaatgaacctctctgtgcctcaatctcctcatttgtaaaataaggataataacagcaacttactcatagggttctaatgaggtttaaataaattaataattgtaaagggcttacaacagtgtctagcgtgcaacaggaatgttttgttcaataaaatttattcaccatcttcagaaaaaaggagggggaaggtgataatattcatactcttcatctcatggtttcatttgggatgattaaatgacattatcaatagagaaacatttttgaaaaggatataaagtcatacactgatgttatccattataagatttaaaaaattttccagatcagcactactaggtaaattatactcaagaaacaggctagaaagaaattaatgattgaaaaataacatcaacctaataaatgtacgtttttaaattacattaaaataagtacatgggtactctttgtggggtagaattgtaagtgatttttatgtttttctaaatgttcccacctttctacaataaaaggtattacttttacaaatacttaaaggaataaaagtaactattttgaaaataattaaaatcctaaaaagaaaatttggcagaaatgtatttacagctatacattatatgtatataatatatattatatatatgaggtggagctactgcacccttcataaaaagtagaatgtaaataaatatcaaccttgcagtcactaatcaaacttattttccaggtcagctatactctggttgttaagatggttctcttccaaaataagagagaaatagctaattcaagaatgattaccagcaggtggaaaattattcaggaggaatagcattgagaatgttcttctggagaaaaatgatgagctaattgaacaaacaaat

SEQ ID NO: 1411 - DNA, 2322 bp, Homo sapiens
agcctcctgagtatatccttttcttttactctcatttattctacctaattctagcccttattgtcaatcacctagattctggggaaaaaagttgtaactagtcttcttgcctccagctttttcccctctattccatcttccaacttattgccagaatggtgttattgaaatataagcctgaatgttttatcccatatttaatggtcctcaattgctctccattgtctacatttaaaaaatccaagcaaagaagccctttattaaaatgaaatcttacttagaagtcacacaatggatatttataattatttatatataacaaatagagggagaatttctgtgatttctgcagcatagaggaaaagagaatcagagccgagcctgctgcctcattcgtgacccttcagagggctctgaggaatccagtcagggtgctatatatgactgagcagaagctagtgagtgcagaaagaaatccaggcaaaaccctttctctaagccaagtgccttggcactgagctgtctctgctgaagggagtgtctaatgcacataaaggcttcttatgagttttctaattcacataaaaacttcttatgagctactggtagcactgatcacagggttctgtggaacataaattgaatccacctgcctttttggataaagccaaagtaccttcacataacacccaagtctttccacaatctgattgctattcacttccccagccctgtctcttgctatataagtagtttcttcaaacattatgcaagttcattggtcaggcctcttcctctgcctgaattagccacctccagacccgggttgtctgttaagtacctttaaagacaaatgcatatcctgaagtagcttcacagtttagcaagagagataggaaaaatgctattaaaattcaatataagtgctatggcaagagaaatacagggtaatgcaggagtacataacaggagaaccttatttggtttttgggggccaaggaaaacttggagcaactgaggcagctgagacctgaaggccaaatagaagttagccaagtgaataaagataggaagaagtgtttcaggcacagtttagtggctgatgaggtaaggagcacagatcaagtcttgaaggtcttggtacgacatgttaaataatttggacttgaacttaaaggcactggaaagccattgtactgcttatagctagaataatgttttagaataattctccaggtacaatgtggagatgtggacttgattagatttggtaggtggagttaaggtagaagaaagcaagaattgttgttagaggctgctatataaccctgataaaagatataatagcctgcactaagccagtggcagtcaggataaagagaaggggacagacatggagggctgattagaatctaatagatgtgctgatggattgtatgtgggtagtgaggaaaggaagaaaatgttttgtttaaatgtctgtcttcacttataaatcataagttttgatttgtggtttatgacttgagggataaaatcatttgtcattcatttttgtatttttagtgcctcacagggtagaacagagttggcacagaatatatatttggcaaatagagtgaatgaattttataagtggggaagttagtcaatgacatctttgctgccagtatccacaccttttcctcatcctttccagtgactttgtcccataagaatgctgtcttctcatctcatctctttcctcctggtataaaaagaatgaattcaaatttaatcaccctaacaaacaagctatcattcataggcatattagcattaagaaaaaaaaaaagaactccagtgatagggcaaggcctaaacaaacacaattgatcaccaataataagacctcaaatataagttgagagatatatgtaatccgcacatacatacattcaaccaacatatattgaagacctgccacagagtaccaggtattgtataggcactgaggacacagttgccaacgagaaagatactggcccttgacctaggggatgaagaggtggggatttacaaattcacatcacagggtcagaagcttatgtcacttacatacaaagctagttctacttaagcacatcttttaaactttagcggttaggctttaaattaaagttcttgtttattattctcatgattattttaattctcagagcttaatttccatagaaacaggaaaattaaaccgtaagtctgaactcaagtataccatgtggcaaactgtaatgttgcttcttattttgaactgttcttcatttaccatgactataacaggtg

SEQ ID NO: 1412 - DNA, 1995 bp, Homo sapiens
gaatgagtttgaggaagaacacactgaaggaatagagaaagttgactataagtcactatatgaaatgccacagaaaattcctttagacctagggaccaaatcaaagatcagaaacaatctatacctatccataaaacattaggctgatggcacaggaaagcccagagtcttatttgtatggccttggaattaaagttaaaattcaggaaatcatttaaacctttaaagcctcagcaaaaagtaagacatggtaggagagctatttcagtagcaacaaatccttgcagtagacatttgcatcacatattggtggcaacttctttgttctcattctgtatattgtagtaaatcaacattactatcattaaatatttatccagtacttctgctagattgctgtagcaaaatgattttctaacttatcttcctatctaattatagacaaaatagataatatgaatataaagaggcatgaacacacaacaaataacattaatattgaaatatttgcagccttattaaatagtcacatgggtagaactctatggaaagacaaaaaatataggaaatacagcctcataaaaatcaaatgaaatagagtcatgggttgctgaacaacagagatacattctaagaaatgtgtgttaggtgatttcggtgttgtacgaacatcggaatgtaattacataaacctagatggtatagcccaatacacattgagactatgtaatatagcctattgtttctaggctgtaaacctgtacagcatgttactgtactgaatactgtaggcaattataacacaatggtaagtatttgtgtgtctaaacatatctaaacatagacaaggtatagtaaaagtgtgatataatcttataggacaattgtcatatatgtgatcaatcattgttgactgaaatgttgttatgtggtacatgactgtataaagcacaagtgttggtaaacatagttgaatctaaatcaggaaagataagaggaaaatggaaatactagaaaagaaggtgatagaattggtaaggataagccaagatggatttcaaagaagaggtgaggatagaatggatttcatttaagttgctttcatctgctcatttaatttaccagatgttcataagaactttttcctatttcagccatgttaggtactaaagatctagaaataaataagtcattgttcctgttgtctaggggttcgtagtataatggggaagaatggcatgtcaactaacaattgtcatttactgagataagtgcttggggaggagtttgcagtcagggaagacttcaataaatatatatttgaggctgagtaaaagttggaaagcaagaaatcaaagaacatcattccagtaaaagtaagtatgcaacgtacctatgtaagagatacaattgcataaatggtaaggaccattctccctggcagaggtaaatatatgcacaaataaatgcttgcagactgaatgataaaggaagtttgagatggctcgagtgtgtacaaagaagtgataaaaaaaggtagatgagtaactttatggagggcaaattggaaagaacattttgtggtatgttggtgattttgtattttattctgtaagtactgggcaaagtttctaagaacagacaattagacaaacaatgtagaatgtattaatatatgtattttcaggacaaagatgggcattcctggcactaagacagacagggaaatcaggacagggagccctccctatttttcttatacactgtgctgacttatacactgtgtttccctttttgcttgagctaaaatccccaataaactgcctttctcaagaccatctcaaactcttggtctatttctcttcactgagggccaagaacccatcagctagtaacattctggcaacccagatggaactggggttcccagacccctgacttaatggacaattctccatagtagtagacaagaagccccctgagcactttctgtgg

SEQ ID NO: 1413 - DNA, 1282 bp, Homo sapiens
tagggaagaaaagtgaaggcctagacctctaggcctccattttcattggcttactgtttgtttgtttgtacaccacagggttacagaattggattgatcatactccaaatctggcaatcttttaatgttggtccatgtatgacctgcttttagccattggttattttaaataatgtaataagaacacatgaactcactgcccaaaacaaaatctagaacctagacaattatctaaccttgtccccaccccatactaacccaataccccttctcccccatctgaggtcaccaacgtcctgaattcggtgttcaagattcctttgccttcctcatatttcagctgaagatcttaaattcacgactagtctgaagacagcatccccagtggactagatgcagaaataaggaaggagctattaaaatcaaccacttgtcccgatgaagtagaagatagcttcttctctgcaagagagtttataaaacctcaaaaggagactaagctccagagttttctcacattaaacacatcattgttgtttttttattctttcaaaaatgcacctagcattgcatgtatttcatttcttccttccctaactactccttgaaatgaaagagaattggggggtgcacagagatgcagaagatgatgaagtaagatgtaacgatcagcactaggaggctggcagcatccacctgccatctttaggctacactctaagccaggcatgtttcaccagtggaagcttcaagacccgcagtcttctcagatttctccctgaatccagacacctcagaaggactcctatcacctagaggtctgtgtagcacatcacagcaagcttagtagcagtgagggtttagtggcattctacctgtgctacctgaggacctttaggcccaggctggctatggaatggctgttttccttggcaacctgccatcatcagtgatgcagtttagatatttgtcccctccaaatctcatgttgaaatttgatctccaatgttggaagtgcggcatggtgggaagtatttggcttatggggacagatccctcatgaccaggtttgtgccatccttgtggtaatgcatgagttctcactctattagttcctgggggaactgactgttaaaaagaaccaggcacctccctcctctgtcttgcttccttcctctcgtcatgtgatgcctggtcccttcgccttctgccatgaatagagcttcctgaggtccctcaccagtggcagatgctgatgctatgcttcctgtatggccttcag

SEQ ID NO: 1414 - DNA, 2544 bp, Homo sapiens
atataaattctagtaacacttgggatgccatgttcaataaatattactgaaggaggagctaacatctgctgcactgcttcagtggtccaggcactcatacactatatataaactcacttaatcctcacagttatcttttccccccagatgaaagtgaactttagagggattaaatgccttgccccaaaccaagtaaccacttagcgacagagccagggtttgaacacagtcatgtctcagtccacattccatgtgctttccactgagctccatgttacaggttgggctccccaggaatcagtctctgagatgacagtagcatgcaggaagttagcaaaaaagtgctcaaggggaacacacgtggggaaggggaaaactcaggattaggcaaaggagaaggtgggcaggtagaactagagccaagcaaatgccagccagcctttttggagggtttgggtggataacggacaatgtcaaaaacagcattaattttcaatcctgggtggtggaaagactatatatatgtatgtatatatgtatgtatgtatgtatgtgtatgtgtgtatgtatgtgtgtatgtatgtgtgtgtatgtatgtatgtatgtatgtatatgtatgtgtgtatgtgtgtgtgtgtatgtatgtatgtatgtgtgtatgtatgtatgtgtaatttctctatgtcagacactgctgggtttgtgctcccctctataatctactgattgtgggacttcacacgaggtacaaaacataagtgacctaataagccctctagacagggcttcagggaggagccaaggctggcacatagtcagagggcaggaaaagttccactccctccgtgtgattaggagggctgctttgttttcttcccaggcagagacctcaaagaaaagtgtgacttgtggcaatcattggaatgctctaacgggagggagccctaagctaaggggaggggctgtatcagccccgggagggcgagggacaaaggggcattgtttccctggagggcaggctggggcaaggctgactccactgccggcctgggcgtgggcaggtttgctcccgggaggagaaggcctccatcctggcccacaatagccaacccaaaacagttctggcaaaattaaaagacgcaggaaaatgccagcgaccgtttattttctcctagggtagatgggggagaaagcagctcctttttctgggctgaatggagtctcagggagggggctaggtgacagcatcgccctttcctctccggctattgcgcaccttctggagcctcgctcagcctgctccctccggcgtaatacgccaatgctgctacccacaacgcacagaccagaaaccaggatagacagaagcctagaatggcctggcatcgagcaggcccagcgcaaacgcaaggtctcttcctctcctttcggtgaaccccacgcccagtcccgagagagagagcggatgctcatttccgaaagctggcaatcctgcagtggccactggaaaaatacatatacgtgtgtgtgtgtgtgtgtgtgtgtgtgtgtgtgtgtgtgcgcgcgcgcgcacacagtgcatatcgtgcccatctacaaggaaacctggaggctccacaaacaactttgagtcccgggagggcggaggtggagagagattctccgcttggataagggcggctggatagccgagtactctcttttggggctgttggccgtctccggagtctcgggagcgccttgatgtcccttcccagggctcgggttcctttgagagaatcaagaggaaggtgtttttcactaggactcgcggtgggccccacctgcctaccgtggccggccgggagctattacagcagggtctgcccgtccgacgacggcggctccaatctggggtcccgccggcgccgacccctcagctctctcccgatacctgctggcctctctcatctttggtggcactcgccgccacggggacggtgagatcaaagaggtagacctaggccaggagggactgccagggctccttcccgcgggccagcctctcgtccttcctcccgggacggggctctttccctttctccggatgcgggcctttgagagtcagcgacgccttagactcctcccagaaaaatgcaccctcatctacccaattctgccctaccctttggagctcctggaccctctaaccgctcggtggggtcagagcccacccccggaagggccgctggtcggggactggttcgccctctcctggcctcctcggaccagtgcgcggggaggatcccgctaacgccgggcgcctgcagaccttgagcggcctcgccctggtgacctccccgggaaaggctgggcggtgcttccacaatgagggccacctgttaatttgcacgagaaagtgctgccgagggcccacacgtgcgaatccacctgtggagtgcgtcccctctctggggccaaggcctaggggaggccgaagcggagaagttgcctgaagactgggaagtaagagtaggggcgtcggaggaatcgaagttgcagtga

SEQ ID NO: 1415 - DNA, 1897 bp, Homo sapiens
aaccttgggtaattaaaattcatatttagctcaaatttctggtaagagaaaacgaactccatatagactagaattagtctctgtggaaactagtatgttctctgaaaagagcacttttcaggttcttctctttttgaaaagtgagttggtcaacaaaatgaaaaataacaatggtgcatacataatgcacacatccacacacatacatgcttacgcacgggcacacaatccaaactgagagcatcgagtgagggtcaccaatggggcagtgactggcaaatgtgaatttctttcatggctgttgatatagttgttaggaaaaaaagatttaagtacacttgttttcaaaatatattatggaaaacattgcagttttacctcaatcctaatcctgaatttttttaagatttcttgttaatgaaattcactatcatgtgtaaaaatgttagtattaaaaatgtaagaacttgttttttcatttcatttggaatgcacataaaaattagtctgtgagatacttatgttaggtgtcattttgtaagggatttgttttaatcccaacaagtgaaataattagcagtttaaacaatgaaaaatgaatgggcactaattgtgattgacatgaaagagtatttctttgattattttaagttatttggtaagtagaataaaagggggagggaaactaaatctgtttgaattcctgctatatgttacacacacagttgaattctccacaaatgatctaagtttattccttacaacaccctatagacaggttttatctctcttttaaagaccagtcaaatacagggaggttaagtatcaagtcagaaatatgagaagtcttctctttcctttatccacaaatttaaccggtcatcaagctctatcaaatttccttaatgtcttgtatattaaacccctttttatattttctttattattcccttaacccttcatcacctctttcctggactcttccaagagtagatcttgcagtagatcttctccacagcctttttctacaatgcaaaactaatcacatgactcctttccttaatgcccttcaacatgtctccatttttcataggatgtactccgaaattcttggcaagctctacaagactctccacaatctggtccctgctcatcacttaaggtttatattcacacattcttattctatttctctcctagacttctcagccatcccaagataattgcagttctgaatctattttctgctgctttatgtctgagtattttctcacctgcctttctttgacttgagctcaccacgccccacctcaaaatttctgccagattgtcttctgtaagctagtgataacgtcacttccttcataaaccatttgctcacctgctacccttgttctctgtcccctcttacaagtgaattgacagctctaacacacatttctaccatagcccacctaactttagtttcagtagtaacttaaatgtttttctttgatcgttagtctgggattaagtttagggttaggacagggacaatgttatattttgtgtgcaaacctggtaactagcatatttcttgggacatcataggcattgtatttcttattttgtttgtaaaggaatgatattggagaatatgaagggtattagaccaagggaaagattagacattcacccataacctagaaaagaatcaattcagggtatccaaacagttatcagtcatggaccttcttttagagttttataattaatattactcaattctaattatttcatatctgtgtgtgtgtcttttccaggtttcaaatttccagtatattaaatctgatttgctcaagttcagtcggatgcgtacaactgaattagaaaaataacttagactcatgtgagatgt

SEQ ID NO: 1416 - DNA, 1607 bp, Homo sapiens
gaactctcaccggtgtaattaacgtaaggtttgctcattgcaatgaaaataggaaatagataaatagaagacaaaatatatactaatatctgtatacatttgtggggaataaagaaggaatgcttctcacaccattaatgtttattcctggacagaagtggaaatggtgtgggtttgactagaaagagaagtcttttacttttcacttgctataattgcttttctcctttttaattttcagtatttttcaaacaaaatcttcaacatgtaggttacttatgttgatatataaatgtgaaaattacagagtgttctgaatcaaaagcatgaaaatcagcaattgcaaacttgggagatcagcacaccctcatggaaatctcagtttagctattttttgcttatgcgagtcagttaaattctttgaggcccagtttctttaagatgaggaaaatgttaacaaaatttcacagttcctttaaaattagagattacatatttttaaacagcctggacagcgtagagcaggagcttagcaaatggtagatgataaaattggaaatcctagcagaagtaataaaacaaattgagcctactacatatgactgctctactccctacctttctgcttgccaattcctgagtcgaggaaggtttttgtgttctgagtagtaacctctgcagggaatttgaatcccagggatgtggtggcatttttatttttacaaatatatttatcagctatgtgtataggtgtgaaaacaaagaggagagggagaaatgtcctttaaatgacagcatccctagggaaaatgacaagctcatggtaggtaaataaattatgtttatgtatttgtatgttcatgtcagttttgttactattttcaagctggcatttgggggttcacagctttcagtttattacagtcactttatttataaaagtataaaacccaggaaaaaatttcccaagtggtgcactaaaccagtactctgaagcaagaaaaagcttttgtctgctttctttgactatttgcaatggaaaatgaatttgaaaaaagaattagaagcctttttacatggataaaatttaattaaaatttatttttagtctcttgaatatgcttcattcttaaaaaaggactgaagtagaaaactatataactaggaaagcatttttttttaatgttctgtaaattcctgacctaggaaaatagatacccatatgcatataccaatggacacttcataaatcatctaagaacaaaaaagaatgggaattctacttttatctttaactatttttacattttcagtactatagttatatgggggagattgggtggcctagccaaataattacccaatgaaagtgaaaaagcatcttccctaatatatgccaagatatttagacatagtttgacatgagcatagaggaaagttgttaatcaaatgagttctttttttttttctttttttttgttgttgttgtttgcaatttgctcttcagatccactttccacccttttctgttctggcctatcagtgttctaggaggctgggtctttgtcctgtaccaatgacctttcttttccttttcctccaggttt

SEQ ID NO: 1417 - DNA, 1669 bp, Homo sapiens
taatggagaactaaaactgttaaagtgaatagaaagaaaatggatagacctcaaaatagagagtgaacatggtaagttatggagtattatatataatatgatatcacttatgtaaaacaatggaaaaatatatcctatttatggatacacataagtggtataattttaaaacatgaacttgagatagcaggttgactgcagtgcttaccactgcggacaaagggagaatgagagcaggaaataagtaccaggagagggtatatacattatctcaacttactgatactttatttcttgaaagaaaaaatctgaaataaatataactcctgtagtgactagacactaaaatgtctcacagtaattctcacttggcatttacaatgtaatctctcactttatctgttggctatggctattaacttgcctctggagaatagattataaataaagtaatgggatatgactcccaacaatgggttacaaaagccactggcttccatcttgtttgtcttttttgctttctggcttgctcatattaatggaagtcagctcgtgctgagagctgtcctattgacaggcccactgggagtggcctctggccaacagcccaagagtaagtgaaggactcagttcaacacccctaaggaatttgaatcctatgagtagtcacgtgagtgagtttacacgtgtatccgtacctattcgaacattgggatgagacagcctcccaccttttgaaagacacagagcaagggttgagccacacctgcttccctgacccacgaaggctgtgaggtaataaacacataatctttgttcattttctgggtttcctttctactattttaactgtaattctatatttctgcagaaaatcattctcatagtttcatagctttaaagtttcctttatatgtttcatctattttaagttgctgtgtcatcttgtgattatctcaacaggttggtattcttttctaggaagccagttcctacattcagcccagatttgtttattcaggtcttgattatgcattcttctttgttctcctttatattttctacaaggcctactttttagtcctgtttgttatataaacagatgctacagagaaaatctgaaaaaaaaaggcaaatgctgcaattagaagagatataattccaattgtcctactattttaagtgctcatagtttatattaaatgtattattctttattcattacattagaaattgtcaaatattgaaaacataaaggaaataataatttcatgaaagtgtcttgtgactatatattaagtttattaaactttaatatttttccaaatttgtttcagtattttttgacataaaattaaatttgagagttcttgagtattttgcttggattgtgtctcacactttctccactcttagaggaattactatacttattttgtcatttacatgcatatatttatatttctatatgtgtgaagcctataaagtacatgtactgttctttaaaatttttgtgtcaatgatactgtgtatatcagtcatgatccaccttttctggatcaacattatatcctagagattcatgtatcttggtatcttcagttctaagttcatttcatttcctgtaaagcataccacactaggactcaattacagtttctttattcat

SEQ ID NO: 1418 - DNA, 3025 bp, Homo sapiens
tttttctgccaattgaataaatctcattctaaaaacacagatgtgtgttggcaggtcctgtgcaatcccaaaacatacagttagagactcaaatatagttatttaaattacctgatgaaagcatgagtccttgcccagctcagctgttgtaaaatgctaacaacatccgagtgcttggtccaggcctttgatcataattctcttggatgcaggtgacagaacagttatgggagtagagatgttggaagttggggcagaagtgttgctactttgttgcatcccctctctccttctaatttctgtagcagtatgaatagatatgtcagataacttggttctcccataggatgcagcctgggtatcttcacaaaaccatgggaagtacccaaagcaagcatttctctgtagagtccaagaatgataagaactaaagctgcaattgattatttgttaagtgccagccactgtgctttacctggattatctcaactaatcctcccaaaaaatctcattaaggagaggactgtggttatcactgtattacagattaggaaacagaggtgaagagaagttgagtaccttgtccaacatcacatggctagttaagtggcagaactgagacttaaacctgaactcacgtttcttagatgccaaagcccacattcttaaccctaggctgaactgccctaagcctacagcccagtggttgtggagcatctaaacctgaggatggcaaataacaccaggacctttggatatttctcagtgctgggagacagatttttggaacaggaccttgtggcttcttgagtaagtgagctgtagtcatagggtcagcttaataaaaagtttccctttcacctttcatacaaggacaatgaaacaacatgagctatgaaaactcatcatgtgcttggcaaaaattctcacagagttagctggagtaaaccttaggtgatttggagttcaagaaggctcacgagctcaccaaccagagcctggcttcagggctggctagctctccgcacagcctcattcatgcccagtgtatgttatttcttaacagttgcttgttgctttgcttattgtcaggcacagtgttggattctattcctacctagattccatatagagtatttggttctctctttctggcaactcattgtttccttctgctcattcaaaaagaaaaagaaagaaagaaagaaaagaaagaaagaaagaggaaggaaggaaggaaggaaggaaggaaggaaggaaggaaggaaggaaggaaggaaggaaggaaaaaagaaagaaagaaatggtcttgcagggatcttttaattatcttggattgggtcctattaccttagactcttcagaacaggagcttctctcattttctttggtctttcatgctgtgtttaacagaagttcttccgaagttccaacctaaatttgtcctaaatttgtttaggctctttccctcttgtcctacttgcattattatttggaaaccaactacatgagaaaaggaggtagctagagaacagagagggtgctgtgtggatcgattgaatcctgattcaagctcagctttttagaagttgacagctgctctgcttattcaaaagaatgtattctttctatgtctatttttatatccttagagcactaggaagccttcgtttgaagggaggtgatctctctcaagagactgagccacatgaaaaataataggggtttcaagcatttcaggtgcctagaaattgctctcttttagaaacaatccttctgcttttgaaacagttaattgaataacgtttacattcataacactacaagaaattgtccaagcccatgtgcagttgtgacagctggaaagcatttttcagccatcttcatgccttagaccctatagaccccttggtgccccctccctccatctctggaagcctataaaatacattttcttctgctgacattgcagcatgaactttccatagcaacttattcccacaccacctgttaataatgccaagagtaatgcatttaactccctgcatactgtgccaaaatgtttacacaattcagcttatttcagagtttaaagaccagacataaatcctaaactagctgtgtcccttccaaacactcagggagttggttgcaacattattgtgggtaagattgggcagatttttccaactattttttaataaaatggggggtactcctttgagactactttgctaactgttttgggctcatcaaaagtgaactgttttgtggaatgtggacaagtatgagagcatcttttcagctaaatatcaactttatcggaaatgtccttaaaacaagaaccaaagcttccaaactgaaaatttgttaatataaatatctgaagattacatctataattcattaaatgaattaataagaatataaattaacatttattttggatttcattgtttataattttagtttatatttgttatttagtaattaattctcgtgaaaatttggtactgcacagatcaaaacctacattttttgccattaaatatacacttttaatatacttttgtcaactctatcagttaaaaagtggggcttttaaccctaccattaacatttttattacaaaaatgtatttatatttatctatttccctacaatgagaatgaaagaattctgaagcatagacacagaataaataatgcctccttgctgttaaaaatttaattggaaaaagcatgtctattttataaacattgttaattttatcctatactttctgactggcacaggacagatattaaaaatattatactttataatctgaaatctgcaaaacctacattttaatgccaataaacctgagactcacactaggaagacatctgcctaagttcacacagctcgtaggtgatagagctgggatttactttctgatgtgtttgcttttaaagccaggactctttcaactacaccataattttctaaaatggttttcttcgaacctcacatgaggagatag

SEQ ID NO: 1419 - DNA, 2001 bp, Homo sapiens
tctgtgcttgcctccaagctcagaagatgggaaagggcaggttttccagcttccattttccttcacctggttgaggaggaaaatcccaggtgacacaggaattgtggcactgttaaattgggaaggaaggcagactgcgtctaaagacagaggtcagcctaagccagaagaggagggaaactcagaagggcttacgtgagcaagtagagattctgatttagcaatcagaacctctgaactggaagggaatttggaaattatcgaattccttgcttctcaaagtgtggtatgtggatcacccagggcttttaaaaattcagaatctccagttttaccgtaaatctaatatatcagaatttgcattctaacaagattcccaggtggttcttttgcacattgcagcttgagaagcaaaagacattcctgtgatttataatattaagatggggaatccgcaacccttaagaggcaaaatgatgagttcaaggccacatagccattttagtggtaaaaactggaccagaaaacatgtcttttaacccccgacccattgttttctcactgtgtcttgctgcctgtcactacatcgcccagctattcaccctatttggtatatattatgtggtacttcttcccaagccttttccatttcagtaattttcacaggtatgtattttattcattatgactttattgcactgagacaaattatttttgctatatagtgatgggtgaactcaaggtcagctgccattgctagcattattgaaagtgccttggtctaactccttggaagctttttaaatgtttgttgcaattggtctttagcctcttataaatttgctgtcgccagatccaagtgaaatcatggtccaaaagacaattgaatggctcagaatttctgacctcagactcagcacaaacaccttccccatcctactcttccctttgttctgtgttccaccttgcttctgctcccaatctcttttgttctctttcacttttatcaaaggcttaattatgcgccaggattttgatcacagatttattaaatgtttaagtatatgtcccttgaatgatagtttctcagtaatgaggtgcattcagaaggagaagagcaggtcaagcatgggtgtaatttggcagagtttgacatcagccatttcatctctgacagggttaatcacagctttagtttttcaagacctggacttgctggactgtgcctgccaaggtcacttggggtgttccaaattaattttaaagacacatggctgcttggagttcactgagttagctcacaatattttttttaaattactcattttgtttcccctcaaattaggaacaaaaatataaattaccttgaaatggctagaaaataatacgccattctaacagaaaaataaaatgaatagatattgtatttacaaggcaaggcaaattcttagagaaaatctgcctttttgaagacaacatacagggcatgttggaaaaattgctgaatattgagttaatcctattcaataaggatttaattggtacctcttctgtataaggcatgttttcgatattgtagggattctaaaaatagctctctgatggagtgtatagtgtaagcataagaataaggataagagaaacagtcaacatctgtcatttcaggaagaatatcagaatcatgagaggtctacattctatgggggtttgtccacagagttcaactgtatgtgaaaggccagaagtggtagtattcaagaagagctttttgccgggcgcggtggctcacgcctgtagtcccagcactttgggaggctgaggcaggtggatcacgaggtcaggagatccagaccatcctggccaacacggtgaaaccctgtctctactaaaaatacaaaaaattagctgggcatggtggcgggcacctgtagtcccagctacttgggaggctgaggcaggagaatggtatgaacccggccgggaggtggagcttgcagtgag

SEQ ID NO: 1420 - DNA, 1917 bp, Homo sapiens
tctgagcacttaactaaaatgtcacttcttctggaaatctcccctggctgcctaagccagagtgaggaactcaaagcaccaattctatttttagttattagaagtagctagtgagtaaaacacaagcctggagtcaaaggacctggattcaaatccctgccttatataactttaggcaagttacttagctgcttcatgcctggctcctgtcttctgtaaactgggctaacagtctttccctcatacagttattatgaagattaaaggagataatgcctgtaaatcatctaacaatagtttctgacacagtcgtgcctctcatcttcatcatctgcattctctgtttgcttattaatatccagttctgagaaggcaggaaccacacactctctgtcatagctccataaacatttgcttagtgacaagcctgcttccttagcaccaggtctccttcctgcctccctccatgcagagctggctccttcctcccgaacaggttatatttgatgcactaaaacaaagtgaggatgagaaagagaaaagaataaacagcgaagcataaatggctgggatatcccagcctcccctggagggtggggcttctggggagggcggcatcaacatctccgtgcgagacccaggaggtgctggtgacattaaatgccgattacccctggggcatgtggttactgcgctgcggtaacccaccccctgaagcgcctgattgcttaagcatctctttgcaaaatgttcattttatttattttttccccatgaatgtttaatcaggtaccttgacgaggcgcacagcagccctctccagagagcaggcagagatggcgtgatcagccctatttgtcacagagggcagcttggagggcggccactgtgcctccacactgcctcactgtccccagcgcatgtccccaggatcccccaccccactgtgccaagcccagtgtgtccagctaccctggctggcagaagggctctagatgtggtcacgtttaccccatacactcattcaggtagtaactgggggtccttaccccaccaccgctacctccatctgctgcctgcagagccagacctcccttgcacaaattggaaacagagggcacctcagccagcccccagccaaactctctgcttggacagctctgcttctcagagcccagactgaagcagaggaaaactcaaggctagcccacttgggaatcctggatcggcttcttaatcctccttcttcccgggcctccctttaattttctttctttcttcaaagccatctgcacaaactaaaggactctgtcctctccactcctcctctcctcaccccacttctggcagaatgccttcccaggtgacggcctctacatctcatcccaggggcaggccactgggggagtctagaacctctctccacaggggagcagctgttccccactccctgagctctgcgtcaggcagcctgctgcattccaccgcccctcactgagtcccagcctcctgggattatggggaaagccattacctcaggattaagcttcagtttgattctcatcaaagactctggtcaccgagtatttgcttaacaccagacctttcaggccccatcaaatttaacaaggcctgacagatttgggattaaacagagaaacccagacaaatccatactttcataggagcccccagtgactgcagcaggacaagtcagatcctagggaaacagcgaccctcatgttagcttctgtgtaatgtgaccaccgcaggggctttgcttcccaggctgacacccctcaccactgcccggctgccccaagatagaatttgatgctttcactctcttgagtgaggaagttcagctcagacatggtcaatgaagcattgattcaggatgcggaagctgtcagggga

SEQ ID NO: 1421 - DNA, 1450 bp, Homo sapiens
ttgcagtgagccaagtcgcgccactgcactccagcctgggcaacagagagagactccgtctcaaaaaaaaaaaaaaaagcttcactatatatttatacctgttaaacttcttcaagtttctgagatggagtttttaaaatttgaagctttaagagactttagaaataaattgatctaactctttcatttacagagacccggaagggcaaataacttgcttgaggttgtatagccagttaatgtcagtcaccagactagagcccaggtctctggacttgtgctctagtatcctcctctcttcttgacaggaggttaatattcatccttttaaattataatgacattttacatgtatagctccacatattgaatacttgtttttgtagcataaaactattcatttttaacatgggaaaacattgaaaatgagaaatgcttgtatcaataagttggagtctttagagataaaaatatttattttagtcttacatgtgtatggttttctgcctaattagaaacacagattccttagtgttagaaaagattctgtattcacaacagcattaggcttaggcattgttgttctctataactttttgctctttaaaagtttagcaattttcaagcatagttttattcctctttattgtgatcataacactttccaaattttttctattgaccattgagtcttggcagaagcaaagggaggagctaggccagtgagaaagctattatgaatggagtgcatggcagctgtacaaggatactgttggtttcccggagctaagcacgtttctttttaacattgttctgagtgatgctgtaaatgtacaggcagaagtaaacaaaaggcagccatttttgccactgcaggatttggaatgcaaaataaagttagccaaatggaggacagactaagcaggaaaatatttgtatcttttagaaattttttggtgaatttttgttttttggttcatgtttgttttttgaaggttaactatgactgccagtttaaaattcactaaataatataggcagattgtttgggtttttgatgtttgttaactattgacttgaattattcacacagggcctttaggaaccattttttaaaagaggttatacataataaggactttttttcctttccaaagaatattaatatcgagagtatcaagagcatggccaggcgtggtggctcttgcctgtatataatcccagcattttgggatgccaggaggcaggataacttgaggccaggagtttgagaccagcctgggtaacatagtgaggccctatcgctgcaaaaaatagtttaaaaaattatccaggtgtggtggcgtgtacctgtagtcccggctacttgggaggtctagttgggaatgtctcttgagtccaggagttcaaagcatttgaggtatgatcatgccactgtgctccagcctgg

SEQ ID NO: 1422 - DNA, 3962 bp, Homo sapiens
gggaaacctctagagggtatttaaaccacagaaaattctgtaaccagtgcttttgagcccccttctcgagcccactcccactctgtggagtgtactttcatttcaataaatctatgttttcattgctttattcttccattgctttgttacagcattttgtccaattctttgttcaaaatgccaagaacctggacaactcatagtcaaaaccctccaccggttacagtttcaaagtagggaaaggagacagagggcactggagcaaagctgaggggacaggacagagggtggagaggtgggaggtgaggtttgaccgatcataagggcaagtccttgcaaaggccaagaaaagggtatggattttcttttcagggcaacaggaagctgtagaagggtttcaagcaggggaataatataaccattttatacttctgtaaagatctttagggagactgaagaggatgttaaataacatcatgagaatgcaatcagtcactgagaatgtgggacatttcacaggacaatgacctatttaaggtggtggaggcaggagggagtggggtgaagaagtcggggcagttaaagactcaggagacatcaacccaatgcaatggacaggcctcgtttggatctcgacttgtattgttttgttttgttttgtttttgagacagaatctcgctctgtctcccaggccagagtgcagtggtgcaatcttggctcactgcaacctctgcctcccgggttcaagcaattctcctgcctcagcttcctgagtagctgggactacaggcacctgccacaatgccaggctaatttttgtatttttagaagagatggagtttcatcatgttggccatgctggtctccaattcctgacctcaagtgatctgcccacctcatcctcccaaagtgctgggattacaggcatgagccaccacacctggcctggatcccaatttgaacaaatcaactgtgaaaagctatttatcaggcaactggagaaatttgaacatagagtattacataatattaaaaagacattgctcattttgttaggtgagttaatggtgtaattaggttaagggaaaagaagtccttatgcacagtgaaatatttacaggtgaaatgaaataatgtctgagatttgcttaacatcttcaggaaaaaagtgcatgggggagaatagatgaaataagattagcaaatgttgataatttttgaagctgggtgatgggtacataagagttcactatactagtttctgaaattttccattaaaaagtaaaaaaaaaaaaaaaaataagttctcggttttctgtggtggggtatgtggtgtccaccatgtgcagcaccctggcaccagtccgagagggtgggactctaaggatggagtgaggactgtggtctggaagatgacatgtgtggggacactttgtgaactgatgggggaggaagtgatagggggccatctacggacactgttcactgcccccaggcatgagcccagcctgcccccagtcagaggcaatggagaagattgactgtgagtagtggggtcagacagacccagggcaacccccaagttggccagttgctttctgctaccttgggtggatcctctgtttcttagctgtgaaatgggagtacttgcagtagctttctcattgggttgtgtattagtctgttctcatgctgctaataatgacatacccaagactgggtgatttattaagaaaagaggtttaatggactcacggttccacatggcctggggaggcctcacgatcatggtggaaggcaaagaagaagcaaaggcacgtcttacatggtgtcaggcaacagagcttgtgcagaggaactcccatttataaaaccatcaggtctcataaaacttatccactatcacgagaacagtatgggggaaactacccccatgattcagttatctccagctggccccacccttgacaggtggggattattacaattcagggtgatatttgggtggggacacagagccaaactatatcagcttgttacaagcattaaatagaatggtgcatgtaaagcccagagctcaatgccaggtgagggtcactgctcccttcctggtagccatcagaggcatgacacaggctgcactgaggcacagcaggactgggttctggaccctcttgggactggtctccagtatctagaaagctgagagctgatacatatgttgaagtacgtgcatcatcatgcgtgtgcacgcacctgtggctacattcacacacacacacacacacacacacacacacacacacacacacacacacagacatccctccaaggtggggatggggctcctcatggcagacctgagcaggcctagagcttggccttcaggaaaggctgtggatggtcctccctagaggacccagcatggaggtgacggagggtgatgctcagaggagactcagccaggggcccaaggataagcctgggcacctggtgagcccaaatgggagaacacagctagacacaagggcagcaccaaggggtaagccagggtctgaggaggtgctgtcctgaccagaaagggacaggctggggcatggggagggcctggctggaaagtctttaaatatgagggagagcatcaccaaaactgcaagccccatgagagtggctgagtttcctggggcctgcttagagccctcaagttgctaaccttgagttgccaagagctggacaacctcacaggccccttgctgctcctgcagcccccacatgtctccacagggttctttctttgtggtcaggccagagaaatgtaagccagccaggcctcctgagacccttcctctctgaagaagcttctggaactcaggtgtgagggaggcgagggtgtacagacagaagtttggggtatcatgcttgggcacccatggctcccaggaagggatgccaaggaagcagggcagagagaacaagcatccccttcctgaggcctcccttcctagacctcaggcacaggaaaagagcccactaattcaatcctgtctctaccagtgggaaggagcttttaatcaaatcctaagttgagtggtgggggagaggagatccattctgccttcacttgctctattccagagaacaatttggggagtcgctaatcctgcaaacatcacgttaacaccaataaaacacccctacagctcccacttgctaaatgtcaacatttattaacttcagaacccagcaccatttcagagcggcctccctgcaacacaggcctggtgagaggagcagctggagtgggccctcgaggagggagacctgtggccgtcaccactgcacctgccctgggtcttgccctgagccctggggcaggccaggacggggctcagagctagcaaaggctgaggcatatccccctggcagaaacttggggacacccatgttggggacgggacttcccttgcttcccctaattcagaggaccttggggaagttcctctccctatccctcatcctaggaaagaacagctcctcttctagcctggcccctgccctcccctaatttcccactccctctcctggaaaagaaatcaagatatttttcttagacatatttcgagttgggtgtcagagggccagcaaacagaagtggatctgcaaagctgtcttttggggagagatttgcatctgcagagaatctgcattgatgcagcccagccttccctcgtcctcaaggcagtagataagcttctgcaccccatcgtggggctgggtcttcattctgaaggctcttgtgtcacataaaactatgatcaaataacattgtatgtcttttctccaattaatctgccttttgtgagctgatcttttagtgaaccttccaaaggtgaagggaaagcttttctttcccactacacctgggaagaagtcctggtgacatttgaaggagagtgtcctg

SEQ ID NO: 1423 - DNA, 3638 bp, Homo sapiens
cacctaggtgattgtttacgagtgtctgccttctccaccaggctgtgagcttcatgtgagcttccaggaaacatgtctgttttgagtcactcttgtactctcagtgcccaaagacagtaggtactgcataaatctttggtgaatgaatggacaatccaagagtaatggatgagagagggatttgcaaactgtaaagttccagtgttctccacctttctgaggctcctctcatgtaacattggccctccatgtgggtgcgttcttaaatgttgtgtggtggggcaggggagcatggcagactctcagtgggcaaggaaagggcatgtgtagtttagagacagcccagagtaaatttgatactttcccctcccctgcatacatgttctctctcttcttttctctgtctctcacatccagggacattgaattgatacaggtttgtgttgctgttgttggcagtgtgttttacacctgttagtttcagcaggtctatcttagagtataaactcccagaaagaaggaactgggtctacaagagtctctgtaaaaggtctgagtacttaaacggagttggaaaatgaatccgtgtctagctagtaaattgtatgtaaaacccttttcatgtgggaggtgggaagggtatgtgttactgtggcagaggctgggggagagcattcaaagacttccccctccagatggatcgcagcaggaaggcctaatggaggaggtgaaactccccccagccctccccatgttgtctctgctttggggaacaagtgcagacatagatgcaggggtctgattcttcccagagtcctgatgttggacgagactttggacattgtgacttagtttctcttttatagcaggaattcttccagcagcctccctggcagataccacagagtcagcattggaaggggctttggacatcgaggtttggaaagaaccagcttagttccaacactcccagagtcggggagctcactactttgtccagtagttcatcccacagttgaatatctcatcgttagctctttctttttctgagctagttgtacttacttgttcatgtccctcctgcttctgcttgaagaataatgagcctgatggctctcccggggcagctcttcaaggctgggatgcctctccggcatcgtcctggtgcaatctgcactcctgtggctgggccctcctggatcctggatctatctccctctttggaggacagggtgggatgaatcagtgggtctggctgggggctgaaggttcctgtgttgatcctcccctcattgtgtcctccccccagatcaggagactttctcctgtgggctctcctcccgctgccccaggcccgcgagtctgtcacacagctatgacttacctaaatgtgtgtcacccagaggacaggaacatttgattgctggggaaaaatacttattttttcctaacgcctttcaaaaaatgagtcatgattggtctaaaaatagtccgtggaaatcagaagaaacaaacacacacacaaaatgatactaaaattcagagtacctaattataggagaaaggaaatggtttggcaaattgggattccagtaatgttttcatattttctttgaatcaaacatcatgcagggagagtgaaatacattcggcattgttaataaattttctaacccagagactcatcgtccctctatcaagctgtttacaacctccatgggcatttctgagtttgtggtttttggacttactcccctctctgcttttccccgggcagctcctgttgactagcataaacctcacaaccggcatgatcaatcaggccgcctgtcatcattgctcagtccagacactgagcaagcaccttgggtgagaaaagcactgtagagggcactaaacaaagattatttctaacattaagtctttaatccgtcttgaattaatttttgtataaggtgtaaggaagggatccagtttcagctttctacatatgactagcctgttttcccagcaccatttattaaatagggaatcctttccccatttcttgtttttgtcaggtttgtcaaagatcagatagttgtagatgtgtggtgttatttctgaggcctctgttctgttccattggtctatatctctgttttggtaacagtaccatgctgttttggttactgtagccttgtagtatagtttgaagtcaggtagcgtgatgcctccagctttgttctttttgcttaggattgacttggcaatgtgggctcttttttggttccatatgaactttaaagaagctagaaaccatcattctgagcaaactatcagaaggacagaaaaccaaacactgtatgttctaattcataggtgggaattgaacaatgagaacacttggtcacagggtagggaacatcacacactggggcctgtcatgggatgcggggccaggggagggatagtattgggagaaatatctaatgtaaatgacaggttgatgggtgcagtgggccaacatggcacatgtatacttatgtaatgagcctgcacgttgtgcacatgtaccctagaacttaaagtataataaaaaaaaaaagaaaaaagaaagattattgagtggatcgttcatgaacccgtaggaagaaaaggagcgatcactaggaagcatcttgggttcaccaagtggaagtcccgccacaataaactcctttctccggctgctgggttttctagactggtagacgtgcagggcacgatgaacatggcatatctggatttcagcaaggcattttgtaaggactctgatgtaatcctcagggacgagatggagaattgtggattagacagtaatagagttagatggattagcaaaccaagagcaatgtgagccaacagtggggtgaggctgccaggaaagcaatgcaatcttggactatattaatcaaagcacagagtgcagaagatgggagataatggtgtggccctctgtgcttggcagtggtcagaccacatctggagacttgcgtttcattctgggagccacaattgagcaaggacattgacgaatgggatagcatttggaggagggggcctgggatgccccagggtcttgctgtcatgccagacaaggagtggttgagggagcttgggactttaacctggaagagagaacacggaaatggatcctgacagctgttttcaaatatttaaaggtctgccctggaagactgagtggaaatatcagatgcagtgttagaaactcagcacttgacagccaggcagattttggttcggtccatagtaccctagcaagaagtgggaggctctgaaccctgcaagagccctggaggaagaattcaatgtggtcttggcctgatgcatcctgttctacacttttctgtcttaccaaaagtaaaccaataaaccctgtgctaagcctggaggaggatggaggggtacagtggcgcatgggaccctggcctcaaggagcttctgtttgagtcagagttggataaacaaacaactgttattcatggaaggatctaactgtttataggaggaagagcacttgattgtaggaaaagaggcctgtttactggttcctgttcagctgccaattagctgtgtgaccttgggcaaattattgc

SEQ ID NO: 1424 - DNA, 2746 bp, Homo sapiens
cttcattcttctggctcatcaacatatcttcacgggccgcgggtctgaaactgcattatcttgccccccggcaagaggaaaatactatcttttttccaccaattctgggtcttttccttggattatcactgaatttgcagctgatgcttctgcagcctcagaataggaaaatatggtgaaagtccattgtaccttcagtggaaggacaacttgccttgtttttcttctttatttgcttattctctgtcccatatccccacccccgggatgtagctttttgagagcaaagaccttgactgtcttattcattactctgattctcctgcctggaagagtgtttgccacagagcaggtgctcaagaaatactatagagcaaattaatttatctttgtcattcttacctagggtagggtttccctctgaaagtgtctgcctgtgagtactccaatttataggcagagatggagttttcaaaatataaagtgttttaatctgacacatcctcgtgataatgaaaatacttcttttttactattattatttttttgtgtcgctctgtcacccaagctgaagtgcagtggtgtgatcttggctcactgcaacctccacttcctgggttccagcgattctcctgcctcagcctcccgagtagctggaattacaggcgtctgccacaatgcccagctaattttttttatatttttagtagagacggggtttcagcatgttggccaagctggtctcgaactcctgacctcaggtgatccacccgccttggcctcccaaagtgctgggattacaggcgtgagctaccacacccggccagcacctctcatttttatagctcgttacattttcaaagcattttcacctcatggggtcttcctcgagcttcatagcagccctatttggatacaggctgaacagatgatgttaccaccatttattgaggagaaaactgaggctctgagaggttaagttgcacaagcccacacgccagggaggagcaaagcaggtactgaacccaggcctgcctggcgctctttctgcaagaccaccagtcccttctccctctgctcatggaaaataaagactaaaaagagcaggtttcttcccgggtcacttcctccctgaggaagtccaatctcaactatggccttaagtggtttggagtcctttggggaacatgattatttgggactgcttaagtgcttagcaaaaagtctgccagacaaagtctaagtggagctgagagaagcaggttttttctcctatgagctgagtcatgtcgaggaagagacaaatggctaccaaggagaaatatgtaagcagactggtcaacacgcatggtcgagcgtgagacagcagactcaggtacaattattctgagaggaagcacaaggcttgactccagggtgtggatccggaagcaagcgttcctcctaaccgggatccaaggatgtgttgccagtggagtggtagatttataggaaaggtggagatggtactgagatggtcttaaatgttaagaaaacaaccataaaacttgtttgggggctggatctgtgcaggatgagtaaggcttttggccgtggtgtgcagggaaagaacatggccctggaggaaaagccatccaggcttgttaatagagctccgtgtgcaggcgtttgggaggagaatgaaggccctgtctcttcttcctaccctaccacaaatgccttagtgaaataactagtccaggtgttgactttttccctttcctaatcctatgtgccagcttatcctatgtgctattcctatatgccagcttatctcagacaaatcaacccatctctctaagccctgtttttcggtaagtaaaatgaaggtatttttttttttcttttttttgagacagggtctagctctgtcgcccaggctggagtacagtggtgcggtctgggctcactgcaacttccacctcccaggttcaagtgattctcctgcctcagcctcctgagtagctggaattacagatgtgcaccaccacgcccagctaatttttgtatttttagtagagatgggggtttcaccatgttggccaggctggtctcgaactcccgacctcaagctatccactcgccttggcctcccaaagtgctgggattacgggtgtgagtcaccgcacctgggcaaatgaggctatttctattctgtacctccagtaagatacagcaaatacaaaagtagaaagtctgtcataagccacaaaaatggtagatgattttgatggcatcatggtagacactttagcagtgtgtaatacatataaggtcacggtatttccaagtatgaaatagctggcaacttgcctgattcttatttagcagtgatgactgatgaaatgacttgccctttgattcaaaccttccacttaacatggtccctcacagcactgggcgtccagtggggaggttttatattactcttctgcgaaggggaaaactttagaacttgaggaagatggagagcaggtgtgttgtattgggggggcagatgagtgaggagggaccacgagaaagatattaagcacctactgcatgtcctctgctatgcttctactatgtgttttgtatgctgtatttatttctttcagcagcctctttaaacccattttacagatgagaaagttaagaatttgcacagcatcactcagtaaaatgggatccgcattttaatccatgtgtgcttgaaggccagcctctg

SEQ ID NO: 1425 - DNA, 2472 bp, Homo sapiens
agtgactcttatcagagagatggagagtcggcactgagagaagtctgcatacaaaaactttactaaaataactctaatcttccattagttctcccacatattcttagtcacttactcctgctttcacatcccttgaaactcaaacttccttttcttcgtttaaaatggtatgtaagccccagaatctaaccactctttccctccctcccgctttcctttctttctctctctccctctttctttccttctttctttctttctctttctttctttctttctctttctttctttccttccttccttccttcttacttactttctttctttatctttctctctctctttctccttccttccttccttccttccttccttccttccttccttccttccttccttccttccttctctctctctctctttcctttcctcctggacttgaactcctggattcaagagatccttccacttcaacctacaaagtagctgggactacaggcacaagccatagcgcctggcttctaactacttctttgagcttcatttcttttctagtaactcccattcatgtaaatattagtaaacattgcgtgctttttctcctgttaatctgttgttcaatttgcaggcctctagttactgaacataagggtagaggaaaagttttttctccctgatgtttccatccctcccacattcctgaaaagaaataaaaagcaacctggggcaaaagggagctatcttttgcagtctatcacagagagatgcatcacagttacagttattctccagtgtcttggggctggggatgtttcctgattgtgaaggaaggttaaaaaaaaaaaaaaaaagcctggagctcattagagtaggttatcttctacacacacacagaggaaatacagaggaaatacaggcatgacccacttcgagcaatcctactaatgcaagactgaaatttgccagaaacaaattaaccagccattagtttatctttttagcatttcctcacttttctaaaaaggattaacaggaatagaaaggcaactctttgtcagtatttatacgtaggtactgaagttgaatggtgacagacacttggggctgaagtagaattaaacttcaattagaaatgaagatgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaagaaatgaagatgaaactgctctgaaatgatcagttgtcattggactcccaatctgaagtgtgaaaaatgccattctgtttacagacattgaatcagcttgcctgcctccaaccctacacactcctgccgatccctcttcctcccatgccaccctcttcctctccagctgaaaaatgctcttttcagatgggatgtactcccctctctcatcacagctaatctaacaatatggcaaattaccagtttcccaatttagctcacaccactcctgccaaaaaccttccttccttttctccatttatctatcatcaaaaccctgggttcaacttgctcttccagcctctgaatggtatttccagcaggtggtatcccaagtgaactccttactcaaatcctttagaagtgatttctttcatgtttgggtttgtacctgatttccccaactaaataatcaatttctaaaatttagaaattttgtctattatgggcatgcacttgcatcttcagtgaattgcacgttgtgtgtataaaagcatattgttggccaggagcagaggcttatgcctgttatttcagcactttgggaggccaaggtggaaggactgcttgaggccaggagtttgagaccagcccttgcaacacagtgagaccgcgtctctacaaaaactagaaaaattagctgggtgtggcggtgcacacctgtagtccaggttcttgggaggatcgcttgagcccaggaagttgaggctgcagtgagctatgataacaccactgcactccagcctgggtgacagagcgagaccatgtttcagagaaaaaaaaaaaaactgtatcattgataataaaaagtagatttatgtgcaactttataaggatttcatctattgtaaaaataaaggctcatatgcactgacatttaattcacctgaaaacagaagagaaaggccaggataagaatataattgtgatgaaaatttgaagctaagaatctgatcagtgagcaggggttttttgaggatctattactaccatgtgc

SEQ ID NO: 1426 - DNA, 2154 bp, Homo sapiens
acaaattctccaactatcaaccagttaagattttattttaaatttttgataaatcagtattttaacacatactggaaagttaatagtcaaccacttttcttattataactactgtactaatttttcccatcttacccctatcaggtaccaagacaatacagctaatgaaatcataaactcaatcccagtgactccagttaagcaatatgatgacagatttctgcactctatcataacctatgagctaaattatggtgctagccactagtcataaagagaactacctaaaagtatatgaaataatacgcacaaatgcattactgatgggaaaaaggaaccacttcaaaacacatgcactatgtaatggcaaattggtacattaacttcaaatataaacatcttcataatttattaatcatgtgtaagacaggatatgcaacaatataaactagaaccagctttttctccaaaatggaaagattagtattgaatactcagctctttctaaagacaacaaaactgaaataaagtcgtgtttgggcccagtttgaacactggctagggcaaataagagaactatatacaatggctgcaaaagagatactgttatttatgatattttcatactgagagatgttactagttttttgttaagcactttggaagaaaaaaaagagtactgcaaatgccattattcctctctcacacacacacaaaaaaatacttttcctgtacatttattacttcactcattcatttgacaaatacaggtttcactctcagaataatgcccaacatttaagcaatgtaaaaaaaaaaaaaaataagctaaggaattagtgtgacccagatatagaagcattttccaaccatagaactggaagatagcttttaataagaacataataagaactgcagaggaagaaaccacaagcacctaccagccttgtcaatgcataaaatggcagtaattaacgttgccatttttgtaagtggagacagtatttttaatgactatcactttgggatatgaatatctaattagattttgctatgcagacatgagattcttctgagaccagtaagaatttcttccaattaagctttttgtttgttttgttttttgtttttttgtttttctggagtagggtcattcaacaattctgtagaaaacaaggagaaagcatatcccaagtctactggcagcttttcccattctcaaacaatcccttgttcagatgcacagccacagaagttcaaaggtcactggcatctttgtgctcagttccatggtagttacaaacaaacttttgtctccattccttcaatgaaatgggctgcaacaactcactgattgaacttttacatctgagaccggcatgagcattacacaactgaagagccatagtatttcatttacacttcaaccataaattattaaacctcctttgtgaaataaaacaatttgtttacgtgggcataaaaaactgataattctagtcaaacacaaataacatcactggcggcaatggtcttatgatttcttatcataattatcatacctctgataacattgttttgaaagcttttgttgactgttcttcagggtttttctcaccctgtctctatcttaaatcatgaaagataaaaagtgaataaatttattacgggctttcatacagagttataaactaaaacttctttcttaaaatgtgataataaatatatttaaataagaaatctcagttgtgacatttattttcaaatagaaaaaagtcttaaaaaataagctcctcattctgtaactgcgaaacaccttagtatgatcatgtaaaatataatattgtctttatctatatactttaataactctttaaacataaaaatcaaacatttaactgtttaagctgtctaccttaaagcatccgttttaaaaataaattcctactactttcttgcgctaaaggcaacctccaaaatcttagcacaataaaatatgttacagctgagcaatcaaaaaataattactcccaaaaatattagccaataattaatctaaaaagggttacataagcatctctgaaataacttttttagcagctaggctgcaaactcctacatgaacacaaaccaactgaatcatgatgctgaaag

SEQ ID NO: 1427 - DNA, 2493 bp, Homo sapiens
ttcaaaatggggctcctaggactgtattagaaagaccaagaagagcatacagtacaggaggtaccaaatggatacagcctcaacattctgagctttgccagaaatgtctgtctgtcttctcccactgtttcctcaattctcttcccctttttcatcttcacctacctccattttcttgagttttcttgtgcagttttggtcaggctttttattgagaacaacctcaactcctgccaatgactttacagccttcctctttctctctggatgttcttaacaggtttggatgaagctgaaatgtaaatgtatctgattcttaattagaagaattcaattccagagtctgttaggactttgggagtaggagatttgttttcacagtaaatattctcagaaggagaagggaacctagtctgatattcccagaggtgaccagtaataggaaatcatcttgacagatgaaaccactcgtatctagaaatcagatgagtagcgggatgagggaaagacagtgaagcctcggaagtgggagttggttcagctttgttagggagatgcaaggagataccacaccagtcagagaaagtcataagatcaagaggtatggaatgtggctctcaagtggaaaaaaaaaggaaggtaccgcattttccattctctgccttgtttttttaattcccgtgataattacaatgagaggagcaatcatgttgctaattttacttcatgcgtttaagttctaattaatactatctggttcttctgcgttctgctgaggtgaaatacagcatgctcctttgcacttacacctttctttctctcaagaatttgcataggaagtgaaggcatgtttgcatgtatcgtattttagtaattggcatccctgccttcacagttctacaccactttctagtctaatctcctggacctttcctctctccattcaccttggcaaaagtggaacagctaggggtttcaaacagccctgcccctcagagaatagggaagtctgatggagttgccggcagcagacctaagccgccagcaggctcttcatggatccccacagagcaagatgggagatttctcacggtgagaactgcacggctgaggccgcatagacattaccattgtcctgtacagaaaaggaaaccgaggcccagggtgatgaagtgacttgcccacgatcacacatttcatagcctcagatctgggatttgagatgtgtctctgcctccaactttcttatgatgatgctgtgagatatgaattatatgagaaagggctttgcatgctgtcatgtgcaaggaaagtttgagctattatttttctggttaattaacaaaaacattgtcatgaaatgtctgctgcattctccgttctcattttgaaagcttttgtggagcacaaaatgttgctttgtgacttctagtggcatagctcacatgtgctatagatgcacgcgtgttatgcttctggcagcccggtgtgagtaaccatggaaaacagttggagaggtgccagtgttggggctgagtgtggggccagctattgtctcagagacacctggtttaggacagatgcctgctgcagtgtgccttcacttcaagcaactgatatttactgactgcctgtgataatgaactaggtaccatggaaggcacaataggttgcaagaggattatggaaagaaagataaagaaaatacacaggccctgccttcagaattgccatatgggctggcaaaggttatgatggaaccctacgaaagtgcagccttgttgggtcagagggagccttgtgaaggaaggggtgtgtgggcgagtaagtagggaggggtgctgtagacagaggggcagtgtgggaaatgggttggggcatgggagagcatgccacactaaggaagctgcaggatcccagacctcaaggtcctggcatgttcttctgaactctttgagcttcatcctgaaggcagtgggaaccactgaaggctcttgaacaagtgattctcaaacagatttgttagaaaggtccctgcggcaaaaagagtgactggactgaagagggttgcgtgtgggaccaaaagagcaggtggaagaggccccccgctcccactgcctggtgttcagaagatggtccattgaagcttaggaaatgatttgagcttgtggttggaggttcaaaattagagagaatgcatgcagggaaataactagctcttctacagcctggctagagtcccttcctacagagaccagttaatagagagcatcatcaaaggcaccaagagtttccgtaaaggacttagataattatttgcccagtgttggttgaaggaaattactttggaatgaaccagctgatgcagttcaagtgcccgaggatacattcctctgcctgacgttttatacctgtgcgaccactgccccgcccccatctgctcccccaatccccgtcaggatcctgcctgctccttccaccagggtgggaact

SEQ ID NO: 1428 - DNA, 7869 bp, Homo sapiens
gaaaaactagttgattaaccagagtatgtatttaaatgtgttgagaaattaatacttcagtagagattggagatagattataaattacctattgtaacaaatactcagtattaagaaaacactatagactataatctcctagaaaacacaaaactgtacagaaatcaggagtaatcaaagtacactgtatatatagttcaactgtgaatagtgttcacacaatcataataaaaacactaattattaatttaaataaaaagtatggcacaactctcttgtgtatgaagtagagtaaatagaaaactcttctgcattagaaagtcaatagatacatctaacactagcaaatcaagaaataatagaataatcatgtttttttgacatatagcataatacgatacagaaagaaaacttttcttaatgatgtcatctcaggagtgaagatttggaattctctaagtgtgagggaatttttttcttaatttttccctattataagccatgtagaattatttcactttgaaaacaatgactatacagatgtgataaagcataacaattaaaattaataaaacaggaaaagtctggctttgaataatatactgacagcaatgaatagtattatggtttagtcataatgataccgagtttatagttttgaaataacaattttgaggtttattctggtatgacaaaattactaaatttgtaaaatgagaatataatacttgactcattagaccagcctcataaggtgactgatttcttcaaagactcattctctctctccttaatctgtaacttctttacaaggagtatctaaactgaattctcagaacacaaaaagagactataaatctctttgctactatacaactgtcagatttcactaaatccaattatcattgggtaccaccctaagttaatttgccactgatttgtatcactgcatgtttagatctgttttacttgctcttatgacagatgtatttccgccattttagcagtggaattaaacggtgaaagcctattgattattgaggaatgataactcagctacacagcagcaccatcttttggcctttgaaggaaaatgatccaaacttatgaatcatgaggtctgtatttctggcatgcgatgtatgcttactttgtgaatcacctttgcaatgcaattaaagtaaggaaatggcttcaaaaggactggaatcaacatttcacatgagatcagatatccacaaaaacaaatcaactgaaaaagatctatattttattcattcaacaaaaattaaagtattattttagaaagtgtttacctttagaattggaattcctttctttttaacttatgaattgcttgtacatttattttgtatggttatttagtattatcatttaagtttattcaacatttctgacttatgaaaggactttctgtaatttatttattttttggaaagctgactccaaagtatgctttttttccatttatctttagagtagtagtaatatatttattactaaacataatcaaatagttatgattctaatatatttatcaaatgtttttaccttttcagatactattatcaagtgctgtctgcagacaatttgcaagaagtgcaaattttatgaaaactagattttgttaggttggtgtgatgaataagacaaatactttgttttagaatatcatttactttattgctacagatgtatttgcagaaattatatataaaaaataaacagaatgcagcatcagaacatgtggtttaactctgaccctaacaatgagtagctctttatactacagcagtaattcaatctttatttcatacatatggaaatatttgctaaaattaatctaaaagattgccttatctaactcatatagatgcttccaggtatatatatatttactttaatagagtttatttagggcagtcttaggttcacagcaaaaatgagctgaagacacaaaaatttctcatgtgcttcttatcccacacatgaatagcctctcccattgtcaacattccctatcagcaccgaacatttgttacaactgataaacctacattgacacatatgcattcaccccaagcctgtaatttacatttatcagggttcactcttggtgttttacattctataggcttggacaaatgtatgatatatattcaccattagggtatcatacagaatattttcattgtcttaaaaactctgtgcctgagtttttataaattgttaatttttgaattgtgttttctttagtttttaccaaataaaacactatagtattttcatattttatcattacctttttcccactatgatatcttattttttcataattctgtggtaccaacatatagaaagctttttaaaaatgtgtatttccacagtcctaaaaaaaatttttctccaaaaaagctttctcattaaagtcaatcttagagtataaacaaaatatttatttatcattcctctacaccacgctgaagcccagagtgtcatttaggtcactgagttgaataatattcagaaatataaatatgaaataattaagtgtatttttcaacatagttagatttaaatctagatctgtcctgcctagtatcatagccactaatacttgagaggctgaggcagaaaaatcgcttgaaccctggaggcggaggttgcagtgagccgagattgcaccattgcactccagcctgggtgacaagagcgaaactctgtctcaaaataaataaataaataaatgaaatttaaaattcagtgattcagtcaatctagccacatttcaagagtgcagtagctacaagtggctaatagcttgggtactgcagatatgaccatttctgaagtactagccttccgtgaagacaatcatggaagaactattggacagtacagattatcatacacaaattgaaatattattatctaaaaagttaatagaaatcaaatgatataccaaaatgtcaacagcaagttaaagtaaataagacctataaggctttaaaaagttatttttttaaatattggtaagcacacattaaacgttttgaaattagtgcttttagcaattgaagaattgaaggcacaaattctatgttacttttcccgatcacagcttctgctttaaaaaaaaaagaaaatcgatatgtctgataaaaatacacattacattttgttaatgacaaatgcttggtttaaaacttcgtggttcaagttagttaaaagaatttcaagtcaaatatacagtctcccagataaattttctttttttttttttttggatctcaaaaagaaaatatatatctttatatttatttttacaaaacatctcacttacaccttagtcatagggtgtgaaaaacaaagaaatagtgaaacactagtaattatattgactagagagaaggaaatctaagaatcttgttgattcaatgtgttttcttttttaatttgataataattcttttcaatgcgctacatactattgcatgcactttacatgcatgaattattttaatcctcacatctgatttaggaaataattattttcatttgtaaatgaagaaattgtggcaacaagagtttaaatgaacaccccaagttcagacaccttgtttatagatgagccaatttttgaatatatgcagtttgaagtttgaatctcgatcccacagtctatgattaaactcttaagaaaaccaattcaacttgtagaatttaaaaggtcacatatgcatgacaggtattaaaccataaacttattttagccacttatgtgatgaagagggagtgccagctcagaaataatcagtatggttgggaaagtttgatgcctataacaggctaaaaatttatccccaagatatccacatcccaattcctagcatctctgaatgttactttttatggtaaaagagactttgtaaatgtgataaagttacaaatgatgaaatggagaaattattctacattacttaggtaggccccaaatgccatcacaaatgtctttagataaagggaggcagagagagaattcacacaaaggaagaaagtgcaatgtgaccatagatacagagattgaagtaatacagccaaaagccaatgaatgatggcagccaccagaagccaccagataagaggaggcaggaaatggattcccccaagaacctctggagagagtgtggccctgctgagaccttgagtgtaagctagtgaaattcattttgtacttctgactctcctgccttgcttgagatctttatttcctcccacatcttccagttactgtctagtgtccttccattttaccctgtaagattccctttagcctttctttcagggtaaacctccgtccgcttttgtttattgggaacatattatttctccttcacttttgaaaaacagttttgctggatattggatttttgattgcaatattttttgttgtttgttttttctttagcacttggaatatattggcctactgcctgttagccttcaaaattctgataagaaatctgattataagtgtatttataatcttttgtgtacgatgagttgtttctttcttgctgctttcaatgttctatttgtgtctttaacttttgaaagtttgattaggtttctctgccatcttgaatgtgtctttgtgggtctctttgagtttatcttggaatatgttgagcttcttagatgtttaaattcacatgttttattaaatttgggaagttttcagccattatttcttcaaatattttctctgtccttttatttaaaatattttttgaaactcctacagtgtacgtgttggtcttaattttttctccagttacacagataccttcagttttgtttatgttttctgttttttttctttctgttcctgagacctgataatatccattgtcctgtgaagttccctgactctttttttatcctgcataaatctgcctctaagtctctctaataatcttttttatttcaattgttgtacttttcaggtaatgtatctcttttggtttctttttaggaggttttctatctcattattaatatatttattttcttccaacattgttttattaacattgtccgcatctttctttagttctttgagctagacatctttaagacgttgttttaaatatttgtctagtagatctgtcatcaggtctttttcagggataatttctgattattttgcacttgaaaggacaatacttttctgtatgctttatattttttttggctaaaagatagacatttaaatctagggccaggcacaatggctcatgcctctaattccagcaatttgggaggccaaggtgggcagatcacttgaggccagaagttcaagaccagcctggccaacatggtgaaacctcatctctactaaaaatacaaaaattagccagtcatgtggtgagtgcctgtaatcccagctactcagcaggctaaggcaggagaatcacttgaacccgggaggcagaggttgcggtgagccaagatcatgccactgtactccagcctagggaagagcgcaagaatgtctcaaaaaaataacaaaataaaataaaataaaagcatgctaactttgaaaatcaaattcacatccttccatagaatttgttgctttctgttattgttttttcttttgtttgttttttttttattgttttagaatgtctctgtgccaaggattagcatgaaatataaattaaggccttcttaggtgttttctgagcttttacctttccctgggaatgttgactcactttctaattttccccatatatgcagtttttttttttttgaatgtcataaattttgatatgtggctaccaaaataaataaataaaaataaagtagggaagaaatctgtctcttcaaatcccctggaagtcacttcagctgcagcaggaggggctacaacaattggggaaatgcaacaacaatggctgtgacactacagttcctccatcaaagggagaatttctctcttcacctcttaaaattcagttggtcctgtaatgtactctggccaatagattgtgaaagaaatgataacttgccagttctgaacccatgtctcaatagcccttgtgtgtattctactacttttcttgaggtctttttctccataacggaccatcctgctagacaataaaagagtgtggagcctaggtgaataagctcagttaccccagtggagtcctccaacggtagaaagagcccagctaagattagcaaagctggttctcagttgatagtagatgcatgaaggatcccagcctagactaaattgctgacctgtagaatattgagataaataaagtcattgatttaaaccactaagctttgaggtcattctttatgcagcattagctatgtaattttttttctcctacttaaactcctttaatagctttccattattcttaacagaaagtctatttccttaaaatagcctaactgacagtagagactgaacaaatacatttgggataaatgattaaataatcactttaataacagttgcttttgttattttaaaaatatagtgtaagaaattctgaaaaatgaaactgggaataaaaagaggagctatttctctgaagtaaatagataattctacagcaacatagaatataaggttgtcaaccaaacaaaaacaagttttctcctttctattcagtgtctggagataacatagcttaccctaagtaatgccatgctgcctacaattctatcttattactatccagagtttaccattagcaaaaagaataacctcactgttgtaaatggcagctgaaccttcagtcaggcatacgttcacgtacatataaattgtgcctgtgactttttgaattttcacaaaattactggctccaatgtttgggctaaaaacattttcaatttctataaaccagccattacaaaaaattttcctggaggtaaatcagcacttttatggtgaaacctgaaccaaagagtgttgatgaatctgctttgtgcacttataggtaggtagtattaaatataaaatccaggtaaataagtaattgaaatgtgttactatttttatataagaaacaaagtggcagatataaattctattctctttctaacaaagtaaagtagacattttgtaattgggccagtgtgtataatctagtcaaagaatcaatttggatatatatggcaacaatataatacaatgccaataaagttaaattttttaaaaaacggattaaaactaaactctgcgttttttctttgtatgctacctttagttaatagctttatcatattagaaatttagttacctttctaaattccttatttccattaatttactgtttaccataaccagataatattatgtcaaacttagagattgtatatctctaaaatccactcttccatcactaccatcatcgtcatttttctaaattgagccacaaccttctacttaaatgttgaaatctcactttaagtttcaaccactaatatcaagcttctgtcagttacatttcccatgtctattcctactcctactctcagagatgcttcttttatacctcttcctctctccaataataattccattctccatctttacttctaatttatgatgttcactttttcttgagaaaataaactaattagaagagaaattctccaggcttctttcatttcatcatcccatccacaaattctggccaatattttactttctctccaaattactgggtgttattaatttgctagggctgctgtaacaaagtagcacaaactggacatctaaaaaaattacaattttattgtctctcagttcag

SEQ ID NO: 1429 - DNA, 1643 bp, Homo sapiens
gaaaaataaaaacaagatcattaatgtcatatgttaattaatataatgcaattaaataatatagccactgtaataaaataaaaaataaagcacacagcaaagtacctgatcagttccagttaggttactttctaccttttacctgtctaaaaatcactggatgtttctttattgattggttccaaaaatactactacatagctgacttttatctttcgtatgctacattctctgagttttttgttgttggtggtgatggtggtggtgttctctctgagccctgaattgtttgtcctatcattttttacatatttctaaaaatataagaactccttcagctccattctccagagggcagaaacaagaagtaaagaaaaattgttcctcactatgagtatgaataacgccctatagccatgtgtttattaagtaatcatagttttcctctttttacaaatatatattggagcagcatgagattcctgtacatcaatgatatgacatgatattaactcaaagcaaagaaacatatttttcttagcctaagcagcctagttgtagataaatgtgaagttatgttgggttttgtaacactaaagacaacttgatgagccccaggagatgcaattctcattgtatggctgaagaagctgagacctaatgaatgatttatccaagatcacacagctagccatgccggagcctaaactctaacccagtgtttctaactctcagataagccctcttacctctgtaccacacttttgatataaacttccaaccagaaagttgtgtagattctattttctcagattattgatgaatatgtcacacgggacagaaataaaaggctcgctaaagtcaagacacagtacattgatcacttcccccgcaatcccggaacctcatcagtctgtcactgctggagatgatgatatcccataggacctcagtgccacacttttcactgtgctgtaatttctgtcagagaaacaagacacgagcagagcccttacctgtcaggctctagcctaacagttcaggggacgcatctcgatccacagctcttagaagcaatttccttggaaacactgtctctagcaacaatatctacaccagtgcttcccaaacactagcccatggatcaatgacaatccatgataaagttatcactggcccacagaaaaatgagaaaaataaaaacaatgtattgggttgttgacacagcgagatgtattcaatttaaaggactgttctttattctgagatcatatatttcttagttttgtttgtagtttccatatcctttgtttttttaaaaaaaatatggtataggactattttttaaaagtcgaaattggaaaaataacaattcatcgtgctacatcatgccaccactgccactatcattataaaataattagtctgcaaattgagaaatcagaaacctctcctctaagcaactggcaatagaggctgtgtgcctggaaggagcaaagtccccaccaagactggttccctcttggccaaaaaggaggcttgacgaagggactgccactgccagtatgggtcatgggacatcagggagcttcgtataaccatatcccaatatgacactctccactcaagtatcttgtgaattc

SEQ ID NO: 1430 - DNA, 8319 bp, Homo sapiens
ttttttaattatactttaagttttagggtacatgtgcacaacgtgcaggttagttacatatgtatacatgtgccatgtaatggttcttaaaatagtttaggagtattctgaatattgtggaagatgctggactctatgtggtggctctaacaacatacaactttctgtcccccaaaagggggttgatttgctttgctagtttccccattatataagagtccaagtgttaaatactaagttaaaattggtctagatgataaatacctgagaggatgtttggtttattcttgcaccttcgcgtctggaagcatcaggcacccgtgagagtccctgatttaagctctgctcactttcacctttgcataaaaaagcagaacacattcaactgttatttttaatcgttcttttcataagtaatacaagttttcttgtgtgttgcgtgtgtgtgtgtgtgtgtgtgtgtgtgtgtgtgtgtgtgtgtgtgttttctaaagaagcaaaacaaaaatgatgaagcaaaaaaaacaatctacaacttcgtaatttgccagttacagccggtggtgcttttacattgctgctgccacctagtggctaccttgtagaaatctatccgctggttctcgggaaagaaactgcagagggctcctcaaacaacgtagcaagcagtcaaaattgattttcctattgtgttagtcctccttgcaacataaacatgtcctaacagaaggaaaatattgcttattaaaaaacgtccttaatcaacaaggaacagagtagatgataaaatccaatgaatgctttggagaaatacaacttatttaacttgtatatgcaaatccacgatagcatctctttttctgtgatttcagactttctgttgttatttcatatagtagattcactggtttccacagagtaaaacgggaaaaaaaagaagtagagatgggttagaaagacagatgagaagaaacctgagataagctctgtgttttgtctgctaatttgttgctttctgggtcctaaatgtgatgattgtggtaattgtttgtgttgtgggcttttcccccaatttttctttatactttgcattgtacagaaaagaatgagccacccagagattatagttgactgttcatcaagtagggcaaatgagccaatgtccttggaaatgtttagacagaaacagagcatcccttctggtttcctgaggcaatttcaagggagaattaatttatttactaattttctgaagaaataggtgaccactgacttgaagtaggattggtgtttagagcacagaaataaagattagaagtgcgcaagcttgtggcaatacaaagcaaatatatatattagtatgttatatattatatactaatataataaaagattagaaatgttatcagaatatcagaaatgtcagaaatatttttaccacttcagcctcacatcacaaaaattggcaatatcgtcagctattcctgttgcatatctcaaaacatcattctacacagtgaatttatattacatgcagatctttatcataagcagtgtggtgcagaaatcctgttataaagaaaaatggacaatatacattttaaagaagtaatggaaaagtataacggagttatccaatggtaattcagacaatacttgggtggtatatcaaccaaggtacaataggaaatagcagcttggagtgatttatctacgttcttaaagagaaggaatttcatacaggagattaggatacaagtcatgaaatgcattagaaaccctaactcaaaagctgggaagtacaagaagctgctaccactcctctacttgatcatcaaaggacagaactgacagtacacacaggaagagaccaaggccacccaaaagaagcctatacatggtagaccagtctaggtgaaggggaagctttgaagcagataccactattgctaaagaagcaaggagaaaagctctgacactttctttacccttaccctacagtcatatgagcaggtctttaattggctgaaaatagtaggaagcctgatgaaaagtgatcctaaatatgtagcgtgcaaaagtgatgatctcccaacatagaatagagataagaaagggagatgaatgaatttaagatcaaaacaagccaagacaggcatcagtaaggacagtaagaagcacaaaaaccaagaggactgacaggggaacagaacatgacctgaaggatgaaggaagtatgaaatataatgaaggagaaaggaaggagaagaatatatcagggcagcaaaaataataaggcaggattccaaggaaagactgtgaatggtgttatcaggaacagcgaggagaagactagacaatttgaaaaagagcatgcggcatctagacaagtttggagagtcaagaagacttgaatgctagaataagaaactggaaatcaattctatagactatccatttccagaagcttatcatacaggatgatagttctggaagatgctacagcagcttgcttgttaaaaggatgttcattgtcaaagagttggggaaatgttagtttttagaatcttttatatgctactgtgctctctggatccatgagatgtatatcataacgtaatataaagtttcataaatgtgtttattatcataatgtaacaaagtttcataaatttatttatttgtatatttataatacatcttattggtctagtggtttattacaaggcactctggaaaaactgctaaataattttgaaatcctgccatttgccagcaaactgaatgaagagtgagatgttcataaggcaactaattcccaaagattgaaataagtaaaaaaatactgttataagaaacttgaattgattcaaatttccactaattcatagtttatgatccattccctggaattatactattaattgaaaatatgttttaaaaaaacaagtgttttaatgggttttaatgtaaaagatttgatctgaaaaagacagctaatattcataattacaaataattctcatgtattcactgaagtaaaatgatggggcttttcattcagtcaggagttttagttgctcaaatatttttatgaaacagtttaaggttattctgattgaaactattatctaatttgaaattgttccaggccgtctatttagaaggtcaaagtggctctagacagaaatgtttaaaactactgaaacaaacctcattgttcatgggtatccagtaataagaaggaaagaattaacagcaggcctgtagcacactccttccatacagggacactggagtggtgggtggagtctgactttggacagacctctttgcaaatattaatagagtgcattgatggaaacatgctaggagtctttatctataaaatattttaggtggatatacctgaccagtctagactgcttattgtagataaatctgggatttatggtttgtggaacttgaatgtctgggaaatgaagagtagttacataagctgtcaaattagtggaatacaaagcagggacatttcaaaattgaaatggctcatttttgagtttaatgcttttgcatatattgctaataaacctcatagttaatcctacaccaaaatgccaaccaggttggaacagaattgatattttggagagctgaatttgaaaatttcgagttcctccagggaatatcttgatgtttgcttgtatcatttgagtcctgagcagatctggttcctggttaagatcctcagtctgatttaatatttcaaccctttttgacaacacagattggtagagtaggcatgattaacttttagacctgtaaattatgatcactcaaacactttttaataagaaatgagggtttcataatgagggtgtaacataatgagggtttgttgccggaatagtgtattcttgttatgaagtagcaaaaaccttgactccatctatggagggaaagatttaacagtggaatttatgggaaataggtttagatctagggagattagctaagtgaatacacaaataatgtaagtttaaagaaggttataaaaccatgctattccctagctggtgatagcagtcctcatcaaacacagaaaaaaagacagacttttaaatctttttaaacgtcaaacatcaaaaacagaaaaaaaagaaagacttttttttaattgattactgaacaaagacattgtattcaatcataacccaggtgacctcagattccagaggttactctggttagagctggggttctttatgaagacatcaaagaacgagtctgatgaattcctgttagcatgaattatcagaaaaaagaagtgatttgggagcatgtcactaattttatatacatttgaatgaaaggggttatgtctcaattccagatggcggaaaactattgtgagaagcggctttcagatggtttaatatataccttgtaacaatgggtaatgataaggtttctgaaggcttataccgagtgaggtaacctccctacactctcctttaccaacagatggaatgactttctttcttttttttttttttttttttttttttttttagatggagtctcactctgccacccaggctggagtacagtggcaggattttggctcactgcaacctccacctcctgggttcaagcgattctcctgcctctcagcctcccgagtagctgggattacaggcatggaccaccatgcccagctgatttttgtatttttggtagagatggggttttatcatgttggccaggctggtctcaaactcctgacctcaggcagtctgcccgcattggcttcccaaagtgctgagattacaggcttgagccaccgtgcctggccacaatactactttcaaaagagtacataggtgcaagcaatccagattggctatacctgatcagattgacacacttaaattcatgctatttgcacaaaccctggtagatgcaaaaatatatcaactatgctccagggatttggggtcattgaggaggagaggagaggagggagtaaaataatattccaaaaacagcaattggtctgctagctaagtgatcatgcgtggggctgaatgatgaagaaaacatttatgctatacaaaaagatgttactatgggggatgggtggaaggaaagaaagaaaagaaaagcagggagagggcctgataaccgacttagctgaatgaagtttttcaggtggctattgaaaaataggaaaaaatgaggaaactgacggggctgccatcattaagctggtgggatgttacagatgcttgaggggataaaacatctactttagcacctccctaacctcttaaagtgctccctcaatttagtcaatatatcctctcctggacaaattcaaatccaatcatgaaggatttagaatgaagaatgcttaaacaaagagccgaatttacactatcagttaaagctatagatttgaaaaaatataaactactaggttgatatctattcatcttacccatagtggggcattaaaggccttttgattttaaatattccagtaattttatgcaaaactatcactggatacaatttctcattgtataggtattcccaagggggatagaaagaaatggtcaaaggtaaaccaggattatatagagatgtcctgataggagagttatgctacaaattagaaaatgtgactagaagaaatattaaatattctgggtgatacgatttggctctgtgcccccacccaaatctcatgtcaaattgtaatccccagtgttgaaggagggccctggtgggaggtgactgaatcggggggcggacttcccctttgctgttctcatgatagtaagttctcacgagatctggttgtttaaaagtgtgtccacttcccaccccctcctgctccaccatgtgaagatgtgcctgcttccccttcgccttccaccatgatgataagtttcctgaggcctccccagaagcagaagccagaagccaattaaacctcttttctttgtaaactacccaggctcaggtagttctttagagcagtgtgaaaatggactaatacactggggttgtgttgttgttattgacatgcacaattggaatgaatattgagtctcaatgagagattctgcctttactacacttgcatgagttagcccttcccttggtttcaaatggacatgataaaggagaacctttataattgcccaagcccttattggatgtaataaataagaaaatggtagtagaggaagtacagtgagtgttcttaacctctttttttcaacagcctgtctggcccgcacatgaggcaaactgattatggaaattaagagtgcattgctagggatcaaagaaagtgctccccactatttctttagctacacccaagagagtaaagactatgcaagaagtacctgaagtgtgcaacaggttacaagtgattgaaaaaacatgaaagacttggctaaggacttttttccatacccattttgaggtccagccaggcacaatttgcgtttttatggaataacgttccatatacatatattttttttcacgtggatacttgaatttacagccatactgtcataattcaatgtgataagccttgaacctgatgaccattaagaatactttatggccaggtgtggtggctcatgtctgtaatcccagcacactatgggaggctgaggcaggtggatcgcttgagtccaggagttcaagggtagcctgggcaacatggtgaaaccctgtctctactagaaaaaaaaggaaaaaattagctgggcatggtggtgggcacctgtagtgccagatactcaggcaatctgcctggaggctgaggtgagaattacctgagcctgggaaattgaggctacagtgagccctggttgtcccagtgtgccccagcctgggtgacagagtgagccattgtctcaaaaaaataataaaactttactgaactacattcataatatcatgataattttctcccagagaaagcagtgcaaagagttaagggctgtggtgctttatagcctgttgagactgactgattaaaatataaatcctggcccattctgtgaaattttgctaagttatgtgggacagagaacagagacatcctttgaactttgagaagtaaattattatctcttacttacctctctgataaagaataagcttggagattggtgggactgtttgtggagatcacatcaacccacctaggaatgctgctgaactctatgactaagaagcccaaagctcttaaaagttctagattgtggttggaaaagccagactaagtgtttgggtatgtttaaaatagacatttttgctgagatagaaagtagattgattgtggatgaagaaatactgaaaaatagtaaatatataccactcagaagagcaaggaaaagctaacttcttttaagcactgtggtttatgaattggctctatcaccaagcaagtgcaggctggcactgagggaaatcaggtaaaatggaactacagaacagtggaagagccacagatttgtaccactggctctacttatctgtgctctgtcattctacctcccatggccaactccacataggtaaattagacctctataagaagagagattcttagcttgtaaataatatccatgagaacatcctacttactctgcccagagttgttctctgcagtactcattggtagaattgggttcaacgtagagaatatttagactatgccattagctcagaggatggtggcattgaggttcccatgcagagtcttacaacattcttacaggtagtgcagtctgaaacaaaactctgggatagattagccatgcttctgacatattgtgacatttcctgtataaaacgatacataatctgtataatgttttaaggaaaaaactacgaattcctgattctacaaacacgtactggagtgagaaaataaaatatataaaagatcaaaagccattgttacttaaatgtgagactgaagagaacagcaatatatagagattgcaggcccaatgtgtgattacactccccatgcattttaagggctgtgaaagaatatctgatttttttttccaaagtcatatagtaaatagatagcactaacaaagtcaaatattaataaccaagaactacagatcctcaaatcccctttcccccaaccagcaaaacccatagaaatttacactgaccaaagtaaatagaaaataaaagtcaaaccacttaaacggttgacatttagggatagagccaggcacttgctttatctttcagaattaccagggttat

SEQ ID NO: 1431 - DNA, 17085 bp, Homo sapiens
gcaaatattttctccttatgtaacttattatcaaaatagaaaaatatattatctggtcaaactatcatttaaatacctttaaaatgactattttcatttttgaagatttttgtgtagagataaatatggggattttcaaattactaaacaaaaatgtttgagatgtagactcgaagaatactgcaatatccaaaattatagagtactaaaaacatttaattataataaaaactttcctgacttcatagacttttaataagaaacatcatgttttctaatttaatgctgttgtaaaaacctcaccatcctgaatcataaaaagagaactacatttcataaaggttacatttgttttcacttctggaaaagaattaaatcaataagttatatttggaagaacaaaacttggatcatatattccactgggtgaagaaaaagaagataccacaaggtaaaactagatgttaacagactaatgatcattttttaataacagaaggacctttctgtgaaaaaataccaacatatatttttttcattgctgtcttctcttccagctaacctttgaatgagagaaacttctgctgatgtcaaatgaccacaaggatattaacaactggacttggagcctgtcggccgctgttggatacacctcctttaccaaggcggctttcttcactactgccactgaccttgcaaacagctccgacaaaggtcggaatggattcattgatcagctagaccgagcatatgacagtctgtgccttaattgaatcccaaaagggggcagactgggtttttattacagaggccagccgatagcactcattaaaagctccacagactgtgtggtttactaattagtttattatacagacaccttgacgatgggcaaagttgtcattttgccctttatcgcacaggggatgttgttaaaagtttaatcagctaacactgaccaagttagcttggcaggctgtggatggtcattactgaggtcacccctgctgtagcaattctgacagggtcacagcatgaacttacaataaagagagtgttacataaggtaagagcgcacctgaaagggaccccagaaaagagttgtgctctgcggggagtatgaaacagatgggctgttaggacaagtgaatccttttcaagtttaccttcgcctgcactgtttaacatatgctttcttaaaaagatgaggcatacgacagtcgttttgatatgttcatcagaaataagattgggaacacgtttttcattttggccaaatatagggtcacctgataaaaatgactctcctgtgttttatttaaaccttacgtagttccagagaagcagaggagattatgttggcctgtttaaacttgctctagatagagcaaagaaacagttacaggctattcttattattattatttctactcagaaaatgattttgagcactagccaaaccaataaaaaattatctagtttaccaacgttgtcccatttattccggggattcttttttcctaatgggctactttttagaatatatagtatctaagaaagattttcttcgtgtgtctaaggttatgcagtgagtgaagtacaggtaatttcactttatgtatttgaaaaagaatcagtagatgaatgtaatattatagttaaaattttttgagaaattcaaaatataatctatacataaataaaatattcatctctctgtgtcaatgttttgactgccatgaagattctagtctgtgatctcaatagatttagtcatacagtcaatcaatttaattgttaagctagcccaaataacatttttcaatccacgatttcaattttctggacagaaacttagtagaattgtactttacaatgtagccatttatgcattttaatattgaatttttgctctaatgggtgatctactgaggtcagtttacaaatttagaaagaggtatctgcaatctctctctgtgttgccctagaatattcaactctctgtaaatctgcttaaatctaaagtttagactgaggttatacaatatagaaattgtgctaatccagacctgatcatttgaaattgatgcttttactagtgtgtgtatatatatatatacacacacgcacacacatctgtctgtctgtcaatctatctacctacctacctgagttatcatatctaaaatagtacctaaaggctttttgacagtaaatacatacagggtaaatgaaataagaatgtgctcaaactatgtatttatttttgaaacaacaaagttttattttgactatgtcatgaaaaagaatatgcaaccctgaacatcatcatttaccctggagattaaaatatattttaatatatttgagatcatattgaaggttttatgaaaagtgaagaaatactctgcattgcattcaaactgcagcagaaattttagtaagcattgtgtattttccaggttggaactgatccaggaatctaaacctaatattgaggctaactgtagggtttgtaaaaaggaggcatcctcaggggttcacactggtggttctgaggaagcttcctgtgaagacagattgtgccctcaagtccacacaggcaaatgcttcatcattaactcactttggaaaaataaataaactattttaacagtgagatttaaaaggtacagctattgcgtatattttctcccatatatcatcaagaaaattgtggaaaaaaaatttagtaagttacctaaattctcactttttcaaaagcatcttgacagtcaatgctatttcaaacacttcactgactttatgtgatacaaaggactgacaaatttaactattaaacataaaagctttcgtacctcataaaacaatttaaaagaagtgaaaagtaaaattatagactgtgaaaagatgttggcaatacacaaatcttacaaaggctcaatatcaagaatgcaaaagcaatgcctataaattattaagacaagagaaaaatactaatgaaataatgcacagaggacaattgaaatacatttactagaaacaaaaatacatggaaccaaaaatatagttatattaaacatgttcaaacttatttgtgatcaggaaaatgcaaaccaagaccatacatattgattggcaaaaaatttaaattctgaaaatcccaaagataaaagacaatgtggacacaaacaagctcatattttaacagtacttttgaaaaaggtttggtattacatgtaattgaacatttacatagccttaacccagcaatcattctctcaggtacatagcccatagagctttttaacatgtgtgcatcaggagacatgcacaaggttgacagggtgaatccatggttgcttcttttttagccataataaaataagccaaccaacaaatggatacacaaataaaagcaggctgtatatatccaattatttaaatataaaaataaatattttgcttaatttaatttgtgtatgttttaagaaaacaagatagaataaaacaaaatgcacaagctacaatgaaggagatactaaaaaccagagtactaactaacgctagagcttcctgggtcgggatgaagaattttgattttagtaatctgggcatttggttttaatgtccatgcagagacagatgagccaagaaattagaatggataaagctgcataaatctattaccttcaacgtgttatggcttcagttaaaaaatgaaccaatatctcaggtagatgttaaagagaaatgtgaaagttctggatgaagaaaagattttccttcttctccggtgaggcttaaccactatcccgattctcaagacagtctgaggtcttcattatctgtatttgaattaggaattctggaaatttctaagccaaaaattaacattataaaaggattaggtcagcagtagttctgttaggttggtataaaagtaattttgggtttgccattaaaagtagtgataaaaatatcaactacttttgcaccaagacaacagaagcaaattctatacttatttggagaatactcctcaaaaaacctaagagtttttttcttccccaaataaaaagatcaagcctcatgaaaataaatttattgttgtgtaattacaaacacacatacataaacatacacatttcactaggattgaggaacttttgacatggaacaaaatagaaaaagattaaaaccacaatttgatgttgttataaaatgaggataattaaaaatataccgtagtcattttaatgatataaaaggtagtctttttttatttgaaaataattttaattaacgtattcataagtgacaaaatgggaaatttaacaactggaaaattttaaaattcacaattattaaacatacgagtgaaataactgaaattaagatctcagtggttgaggtcttttttaaaaattattactatactttaagttttagggtacatgtgcacaatgtgcaggtttgttacatatgtatacatgtgccatgttggtgttctacactcattaactcctcatttagcattaggtatatctcctaattctatccctcccccctccccccaccccacaacagtccccagtgtgtgatgttccccttcctgtgtccatgtgttctcattgttcaattcccacctatgagtgagaacatgtggtgtttggttttttgtctttgctatagtttgctgagaatgatggtttccagcttcattcatgtccctacagaggacatgaactcatcattttttatggctgcatagtattccatggtgtatatgtgccacactttcttaatccagtctatccttgttggacatatgggttgtggacaaatagtctttgctattgtgaatagtgctgcaataaacatacgtgtgcacatgtctttatagcagcatgatttgtaatcctttgggtatatacccagtaatgggatggctgggtcaaatagtatttctagttctagatccctgaggaatcgccacactgacttccacaatggttaaaccagtttacagtcccaccaacagtgtaaaagtgttcctatttctccatatcctctccagcacctgttgtttcctgactttttaatgattgccattctaactggtgtgagatggtatctcattgtggatttgatttgcaattctctgatggccagtgatgatgagcattttttcatgtgtcttttggctgcataaatgtcttcttttgagaagtgtctgttcatatccttcgcccacttgttgatgggattgtttgtttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaatgagatcccatttgtcaattttggcttttgttgccattgcttttggtgttttggacatgaagtccttgcccatgcctatgtcctgaatggtaatgcctaggttttcttctagggtttttatggttttaggtctaacatttaagtctttaatccatcttgaattaatttttgtctaaggtgtaaggaaaggatccagtttcagctttctatatatggctagccagttttcccagcaccattttattaaatagggaatcctttcccctttgcttgtttttgtcaggtttgtcaaagatcagatagttgtagataagaggcattatttctgagggctctgttctgttccattgcactatatctctgttttggtaccagtaccatgctgttttggttactgtagccttgtagtatagtttgaagtcaggtagcatgatgcctccagctttgttcttttggcttaggattgacttggcaatggggctcttttttgattccatataaactttaaagtagttctttccaattctgtgaagaaagtaattggtagcttgatggggatggcattgaatctataaattaccttgggcaggatggccattttcacgctattgattcttcttactgatgagcatggaatgttcttccatttgtttgtgtcttcttttatttcattgagcagtggtttgtagttctccttaaagaggtccttcacgtcccttgtaagttggattcctaggtattttattctctttgaagcaattgtgagtgggagttcactcatgatttggctctctgtttgtctgttattcgtgtataagaatgcttgtgatttttgcacattgattttgtatcctgagactttgctgaagttgtctatcagcttaaggagattttgggctgagacaatggggttttctagaaatacaatcatgtcatctgcaaacagggacaatttgacttcctcttttcctaattgaataccctttatttcctcctcctgcctgattgccctggccagaacttccaacactatgttgaataagagtggtgagagagggcatccctgtcttgtgccagttttcaaaggcaatgctttcagtttttgtccattcggtatgatattggctgtgggttggtcatagagagctctgattattttgagatacatcccatcaatacctaatttattgagagtttttagcatgaagggctgttgaattttgtcaaaggccttttgtgcatctattgaaataatcatatggtttttgtctttgattctgtttatatgctggattacgtctattgatttgtgtatgttgaaccagccttgcatcccagggatgaagcccacttgatcatggtggataagctttttaatgtgctgctggattcagtttgccagtattttattgaggatttttgcatcaatgttcatcaaggatattggtctaaaattctctttttttggttgtgtctctgtcaggcattggtatcaggatgaggctggcctcataaaatgagttagggaggattccctctttttctactgattggaatagtttcagaaggaatcgtaccagctcctccttgtacttctggtagaatttggctgtgaatccatctggtcatggactttttttggttggtaagctattaatttttgcctcaatttcagagcctggtattagtctattcagagattcaacttcttcctggtttagtcttgggagggtgtatgtgtccaggaatttatccatttcttctagattttctagtttatttgcatagaggtgtgtatagtacactctgatggtagtttgtatttctgtgggaaggggtggtgataccccttcatcattttttattgcgtctatttgattcttccctcttttcttctttgttagttttgttagcggtctatcaatttcgttgatcttttcaaaaaaccagctcctggattcattgattttttgaagggttttttatgtctctatctcattcagttctgctctgatctcagttacttcttgccttctgctagcttttgaatgtgtttgctctttcttctctagttcttttaattgtgatgttagggtgtccattttagatctttcctgctttctcttgtgggcatttagtgttataaatttccctctacacactgctttgaatgtgtcccagagattctggtatgttgtgtctttgttctcattgttttcaaagaacatctttatttctgccttcatttctttatgtacccagtagtcatttaggagcaggttgttcagtttccatgtagttgagcggttttgagtgagattcttaatcctgagttctagttgattgcactgtggtctgagagacagtttgttataatttctgttcttttacatttgctgaggagtgctttacttccaactatgtggtcaattttgggataggtgtggtgtggtgctgaaaagaatgtatattctgttgatttagggtggagagttctgtagatgtctattaggtatgcttggtgcagagctgagttcaatttctggatattgttgttaactttctgtctcattgatctgtctaatgttgacagtgggtgttaaagtctcccattattattgtgtgggagtctaagtctctttgtaggtcactcaggacttgctttatgaatctgggtgctcctgtattgggtgcatatatatttacgatagttagctcttcttgttgaattgatccctttaccattatgtaatggtcttctttgtctcttttgatctttgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgtgtcttgactctttatccaatttgccagtctgtgtcttttaattggagcatttagtccatttacatttaaggttagtattgttatgtgtgaatttgatcctgtcattatgatgttagctggtgattttgctcgttagttcatgcagtttcttcctagtctcgatggtctttacaatttggcatgtttttgcagtggctggtagcgattgttcctttccatgtttagtgcttccttcaggagctcttttagggcaggcctggtggtgacaaagtctctcagcatttgcttgtctgtaaagtattttatttctccttcacttatgaagcttagtttggctggatatgaaactctgggttgaaaattcttttaagaatgttgaatattggcccccactctcttctggcttgtagagtttctgccgagagatcagctgttagtgtgatgggcttccctttgtgggtaacccgacctttctctctgactgcccttaacatgttttccttcatttcaactttggtgaatctgacaattatgtgtcttggagttgctcttctcgaggagtatcttcgtggcattctctgtatttcctgaatttgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggctttgttcatttctttttgttattttttctctaaatttctcttctcacttcatttcattcatttcatcttccatcactgataccctttcttccagttgatcacatcggctactgaggcttttgcatttgtcatgtagttctcttgccttggttttcagcttgccttggttatcaggtcctttaaggacttctctaaattggttattctagttagccattcatctaattttttttcaaggtttttaactcctttgccattggctcgaacttcctcctttagctgagagtagtttgatcttctgaagccttcttctctcaacttgtcaaagtcattttccatccagctttgttccgttgctcgtgaggagctgcattcctttggaggaggagaggtgctctaatttttagagtttccagtttttctgctctgttttttccccatctttgtggttttatctacctttggtctttgatgatagtgatgtacagatgggttttttttgtgtggatatcctttctgtttgttagttttccttgtaacagtcaggaccctcagctgcaggtctgttggagtttgctggaggtccactcaagaccctgtttgcctggtatcagcagcagtggctgcagaacagtggatattggtgaactgcaaatgctgctgcctgattgttcatctggaagttttgtctcagaggagtacctttctgtgtgaagtgtcagtccacccctactgggggggtgcctcccagttaggctactcaggggtctgggacccccgtgagtaggcagtctgcccattctcagatctcaagctgcatggtgggagaaccactgctctcttcaaagctctcagacagggacatttaagtctgcagaggttactgctgccttttgtttgtctgtgccctgcccccagagatggagtctacagaggcaggcaggcaggcaggcaggcctccttgagctgtggttggctccacccagttcgagcttcccagctgctttgtttacctactcaagccttggcaatggtgggtgccccacccccagccttgctgtttccttacaatttgatctcagactgctgttctagcaatgagtgaggctctgtgggcgtaggaccctccgagccatgtgcaggatataatctcctggtgtgccgtttgttaagtccactagaaaagcgcagtattagggtgggagtgacctgattttccagctgctgtctgtgacccctttctttgactaggaaagggaattccctgaccccttgcgcttcccaggtgaggcgataccttgccctgctttggctcacgcatggtgcgctgcacccactgtcctgcacccactgtccggcaccccccagtgagatgaacctggtacctcagttggaaatgcaaaaatcacccatcttatgcatcgctgatgctgggagctgtagactggagctgttcctattcggccatcttggctcaacccccgccaaaatgtagtcattttaattataattaaaatgaatgaaactattaaagaaaaatacaatttgagtaaagtacataaaatgaaattaataatggagagagaatagcaaaaactatagaaataaagaatatatttaagctttcaaattatcagcttaaattaaaatgcaattatacaggtgaccttacacagctaaagaaggttggtgaactagaagtaccttaaatagactacagctcagaaactacataaataaaataatagaaaatatatcaaggaatctgagcaccagaagaaagaggcccagcagatacttaattgtaattcaaataaaagagaaaataagatagtgaattatttgaagtaataatggatgtcaaagacataactataagactgaatataaaacgagattacccaaaaggaaagaagagacaaaaaattttactcagattgtttttaaaatttttaaatacttatgccaacaaaacacatttttgaatacaaaaggtttgatattccagatgcagtcaagcaaacccaatgtaatacagtttattccttgtttaatatttatctcccacaaagaatgcaagcagtgtaagagcagaattttttgtttctgttcacttctgtccattgtttacataaaagattataaaataaaacagaaaacaaattttttaataattaaaaaactcattattgaagaaaaatatattgaagaaaatataatagccaaatctatataattctatgcctattatcatattaatgaaagcaaaataaatatattctgagacaagtagactgaattttactcacattattatttctagataattcttatgtatatattttaggaagaaataaattatgtaatggaaacaatatgaacaagtcagttaatttaggaaatatttgggtaaatgtaaattataaattttacaagctaatattaatacttggtttataacgcaaggtaaattgaaataatagcacaaatatatcaagtaattatgggggggtcaaaaaagtctaagtgtcttgcctcattaaagaagattttaaagggattgtttcactttagactaaaatacataacttccaaatcactagagggatgaaaggaatgtggtggtggtggtaagaagaacttaatcactcccataaaaacaaaagcgaatacacgcctgtaatccctgcactttgggaggctgaggtgggcggattacgaggtcaggagatcgagaccacggtgaacccccatttctttaaaactacaaaaaattagccaggcgtggtggcaggcgcctgtagtcccagctacttgggaggctgaggcaggagaatggcgtgaacccaggaggcagagcttgcagtgagccgagatcgcatcactgcactccagcctgggagatatagaacgagactccatctcaaaaaaaaaaaaaaaaaaaaaaaaaaaccaagagcgaataaaagttttaaaaattcaaaacagcacccaaaatattagaaataaactgacataaaccagtcactactctaaataaaagtgaactaaatttatcatttaaaaatggaagacgacacaagcaaaatggcagattaggaagatccaagcctcagttttcccatggaaataccaaacactactacaaactaggagaaaataaccttataggaatctgagagggagccaaaagtctgcagcagctacgggaatgcccaattaagaaaaagccatattctaagtgggaggaaatctcatggtgttttttaccagccttgtctcactctccagaggggttaaagctgtagagaagtggagttgtgttttgttttcgttttttttttttttttttttctgtgtgtgtgtgtatgtaattcagcccatccattttacagtaattactaagaaaagttcttcagttgtagaacaaaagatattggatgaaaatttgagcccacacacacaaaaatttaaaatgccaataatatttaatattgaataaatataaaatgtaataaataattgcctcttagaatcgggtagtgaaggctaagaagagtgatgaagttgtctgatttcaagaactaattattggtgaggttgttactgcctggtgggtttagagggacattcacacaggtgggtgacctagcatgggctccagaacatgataaatgtgagaatgttgtcattggatgtgtgtcaatgtagttgtgtcagtgaatcttagcacaggatgccagagtctgagtcaggtgagaatggcatccacacttatgggaagcagcctggcatggggttttgaagccctagttgggtgaaggagaggaggacaatttctctgtgtggaaaatccaagcccaggatgagaaagcacctcccttgcatagggatgctgtctgtcgtgggttgtaagagcctgattagggtgagaagggtgtccacactgggagggggctgatatgatgtggagtgtcaggtggaatttggagagtgccactgtagagtccaagcctgcaatagggtattagagctcaatcaaggtgatggcctggtggagagcctaaaaggaaagcccaacctgattgaattggagggagcatacacgagggacgacagcctagcacaggatgttagaccaccagcagggttagtagggcctccacatgtgactgttgtacagtggagagtgttggaccagactggggtgaggagaggaccacacagggtaccacgctatgtgtaagagtccacaggggagaacagggtatccacactgggacagtgatgagttcatacggggagttgactcacatacgtaaatatattaaagatggttaaagtcaggtttctcaccgggaagagagttacaaataagaaaagggagaaaatgaaaataaacactatagaattggattggaatggtaacgaaaataaacactatagaattggattggaatggtaatgtaagtatggttttcagtatatatgaatagatataaaaatgatatagatgtaaaggtgtgtgtgtacaaatatgaatatgtattttctaactctttccacagagagtgactagagcaggaatacctctataacaatgagtgtaggcaataccagatcttgtttttcaagtacaattctccattttccgcttaaaggaaccagacctccttgcatcaattgcaaattgcaggcctaggaaacagaaagttaaaggtgaaccaggaacaccttactgtgtcagaaaataagaaagtggtaaaaaattatgggaaaatattaaaaggacacaggggccagactgaaagagctctccttgccaaaaattagggcaatttgaggattagtataaataatgacagcatggaattataacccatcaaataaccattagtctgtgctgatataatacattgatgaaaaagtgagactttgaagcatcaatccaagagtcaaacagaaccctgtcacatattaacagataatattaatttggccgtggttgctgtattccaaatagacaggggtagttcaaaatttaaaatagattaatgccatttaccacatatatagatcaatatagaaaacaatataaatgttgtggctgttaaaagcagatttgataaaatgcaaggtttacttttttaattaaaaataactctcaatataaaagtgtaactagttatctcatataaaccaaagtgggacgagcctcctaactggtctcttccatctagccttgaatgcccaacctgcctctgctggcaatttctatttttcacataagctaatattatttatttaaaatgtaaatcaaatcagtttttcattttcttaacctcttgtagctgtccacgaactatatgtgaaaacgaaactataaaacacaaaactgtcaaacatttggcagaaaacaagaggttatcttcaacgacatttgagtaaggaaggatttcatgaacatgaccaacaactcactaagccatgtttgattgatcacaaggattcagcctctgaaactaggcaagggagcctcctgatggtcctggacactgttcacagtggtctccacaatcaccaagtggagatcagagtttcaagccatacctcggagtttcctgacatgtggtatttatatttttcctgaatttttcctggagaatgaattgtaatagcatgtttttcaccatcttgctactcgggagtttccctctctcttgtttctcagcagaatgcaagcatggctgttaataactttgtagaaaatgtctctttctcaattaaaacaacaatgattctcttagatcacctgtcctttgcttgtgtaaagccttcaaaggtttgtatccctgggtgattaatgaggggaaagaaaagaattaaaaaaaaaataaagctattcattccagttaaagtcaacgttggagtttaaaatacagtaagtaaagcttaaattctttcagttatgtggataatatcacagaagcaaaaataaaggtaatggaaaggaagggcataatgtaaaatatatgggcagaaaaagagacatttaccgagtaaaatagctacgtgggtcacttaataggttattaggctgaaaacaaaatcatgtagcatttttgcaactttaaatgaaaattaatttgattgataaagtagatagaattcagtgaattcttatccctgaacttttatttcacataaagttgcaaagtggcattattttaattgatattcagaatattataaacctaaagattcaattgtttaaagtaagaaaacattattttctgtataatttgcaaagggatttcactggcatctcattaaatcctcctaacaacctaaggtaggcagaaattttaatcatcattctgagatatgaaaatttagtttcagcaactcaacttggattactatcctataataatccttacatctatattatcattatttaacctgttggcaattgtctttcttttatatgacttcatagtgtttgttacacgaaagggtcttaatacaaaaattgacatgcaccccgatgaatcagattaattcagtctaatacaccttgaccataaaatacgcccatcttatcatgacatagttttccttcctggtattaagcttcaagtctaattatatctgtcttaaagtacttggatccatttattttaaatgaatcatctgacaaaaaaagtacttagagaaagactaggaagatgaaacaataatttggaattagaaataaatataagtgaataaagaggatgctctaatttcttagaggaaatctgaaagaaagttgtaaaaagaaatgaaaagagaatagagtatcaaaaaaagaaaaaaaaaaagagtaaataggctggtccgaacatactgagttacctcaaatgactattcaaaaacattaacagacagaatttcttgtcatactctttcctcccttctcactactgtacttgactagtcttaaaaaaaaaaaaaaaaaaaaaaaaggaatactcagtagcattaaatgctgtaaagaaaaaaagtcaaaggaaaaggaaagctggaacatatatattatttaagatcatgtgaagaagataggcaagggccaaacagcaaatgttcacacaagacacattaaagatttcggtttgtagccacttttttgaggcatacaatatgtttcgttacctgcacccatttaaattatacatttcagaattttgacaagcgtatataaacctgaacattacagatattgaaattaaaagaataatgagaaactatcagatttagcaagtaaaggttagtgggaggcctgtgagaaataaattagtgagatttgaaaataagtaggttataatcaccacgaatgtcttcaagaaactttctttagcgtgcttaatcatgatgtatggcctgatagaacaaatatttgaaatgataactggcaactttttccaagagttctttctttgttgttattaaaagctattttttttgcattagtttttattatgatgggtttacatatagtcgtttaaaaggtaaatctaagcatacttcttatttatttttaaattttttgtggtacgtaacagttgtacattagttatgcagtatgtgaactagttcaatgcaagtatactatgtgtaataataaaatctgagctattagaatatccatcacctcaaacactgagaattcttgtgttgggaacattccaaatccactcttctagctcctttaaaatgtacaatcattgctaactatagttgccccattgtgcttccacacactagatcttattcctactgtctaactagttttgtactcattagccaatctctatttacatgcccctcccactacccttctgagtctctctaaccatcattctactatctaattccatgagaccaattttttcagctcccaaatatgagtgaatacatgtgatatttgtcctt

SEQ ID NO: 1432 - DNA, 3050 bp, Homo sapiens
ccaaaactaaatcaatcctcatttcctcacaattgaattgagggctaagagattaataaaggtgattggaaccctgtcaggaagacaacaaactggagcctaacatatcaccatctgaccactcgataggtgaattctacttatccttcaaagctgtcccagtgctacctctatcattaccttttatgctgaagatgttttcactaccataaaaaccacaccacaatggtttttgtatttcttattttatgaaattaattttccttattaacatggttggggacattcacattctatccatgtcttagtatgttaagtatttcaagagctaagtctatgccaatcatctggactgcctaaaatatagataggacttaaaaattagcagattctcaaagtttatttaatgatgaacaaatgaatgtacacttaagacctctaactcactagcacaagtttacagaatttgatctcttgtattttcccaccaatatacttaccatcgtgactttcacccagcattctcatgcaaagatgcatttcagacaattaagataattggttgaatcgggttatctcttctttgatgcagctacatatttgtattataattgggactttaattgttaataacataagttttttttccatgtctatctttctcccctacttcagcataaactccttgaaaacaaagagaccgtggcattgtgtttctctctctctctcgtatgtgtttgtgtatgtgtccttacagagaagttgacagcaaacgtgttggatacctgcctgattatttttaaaaattatattcttaaatcaggcctatttggtatataaaaaagagtatttttaaacttctccctcttgttccatttagatttagccattgaacctgagaggccatctagttgttagatcagatattgccagaggataaatttttcatttttagagatctttctattctttgtttctcaaatatggtttttgttctaagcatattctaatattggcacagaaaagaccaaataaccttttctcttacactttctaaaatccctcttccaaatatgataccatctgtgccaagaatgtgaaaaagtaaaactgtaattcatctcaaaaatgtatcttgatgaaataattattaaaagtttttctaagtcttttcttctgctgccttatggtggagacaaattcctatcaataatgaatataattgttagtgtctttcttcctttattctgacttaagccaaattagaatattctcacatttaaaataaatgcattaacaacacactgtgaggttacttgttacgcatcaaaataatcattctctcttggttaatggaaattctatggatattatttgtaaaaccttcctaaaatttctattaataataaataatcctgatgcttctttctataatatataacctgaaatttaaaaattatgctgactttattaaagactttttttttcaaataagaacttaaatcagattcaataggcttaaactctaagtggagtccctaagactattcaaaattcaaagttgcattctgaacagattgcacaagctagttgatgaaacttgagctaattacactaatgttgacaaatgcactggcacaaaaacaaatgtcacatttttcaaaaaattacacctcttcaaaagatgctaaatagattcagtgatttgtgggtgtaactgagctatttgtgcaaaaacagttttgaaaattctgatttaaaatacaaaaagtacaagtgcagtatgcgcacttatatgcaattttcaaatgtattttaatgaaatacttgaagttttgaaacaataaagaaattgctatatttggcactggaagattatctctaagttgtttattttaaattatgtatcatatacaaaaataaagtctttctatcttgaagaatgcctttatttatttttaaatgagttattatggatatctcaactcaaaatgcatttctaaaagagatttgaatctgtacactctcaggaacagtatttctcatacgttcagccacaaatatacttaccttttctattacttggcaaaagagctagtatgttctgaaagttttgtgctagacattccgctaaaagttttaagtaaatgatctaatttcattcttctggtaggcctgtaagggagaaatcataatctcctttttaaagatgggatatctgagaatcaatgaggtcaaataactcaccctagctaacgaagctggaatttgattcaaggtatccctgactctcaagcttctgcacttcatgctatccccaccacggatctcaaatggaaagtgtttgactattatgtatttaaaattatcagcttccttctatattacattcaagggaaagttacagtgatgtttccagaatatatcaatgatgcctttcgtgttgggatttgtcttttctttgttgttttaaactacccccaaatcactgttgtgctaccttataagaggccaatctgggcctcatatccactatagcttaagtaattagtcttgtctgacactttagaattcttaattaaaaaaataaagtggattagaaatattgatatcagaaatcaagtttgcaattaaaaactaaaaagtaaattcaaatatcagaagttgtgtttgtcgtctactaaaatcctgggtagatgaagaatcttactgaaaaaaacctgctcctacccagcaacagaaggataagattcatttggccaatatattatttgcccttatcattagggtttaaaatggtcattcagtttgaagcaaccaaagtaacaaatatgtcacacaggagtcattgaagtatattgtatattatttttggcctataaatttcatctacaaaccaatactgaaattataaagaaaatactaacctttaagtttgacgtaaacagagtagcaatattttttatttttctatctcctattatgagccaattcaaactattctatatttattaaattttaccttcactagaattttctcttgtctctgg

SEQ ID NO: 1433 - DNA, 2895 bp, Homo sapiens
catctcttatttgagtttcacgtttttactgccatttaaagttgaggaaacttaggcctcgagagagaggaaatactggctaactttcacacaggtagtaatgagtcctcacatccaagtttttcacttaaagtccaagactatttctgcagctctggggcctccttagtaaataggtaatatgcttaatcttcattacttgaaatttgccaactgctcatgtttatttgcaaccctcaaatcaatacttgtgatccatttgcagtcatttgaggtcatatgcagaggggtgaaagagttcactcgcccaacgggcacactcctagctgaggccaaacaaggtgacactctgccttatttctgttctcatgctataaacaagtgtccttcttgcagtctacttagtgccagacttttagcatttttgtactttttgttgatgatttccctgtttaaacatcccccaagcatagtgttggagtgctgtctagtgttcctaaccacaaggggactatgatgtgtcttgtggagaaaatgttgtgttagataagcttcattcaggcatggtcacagtgctgttggttgtaagaccaacgttaatgaaataacactatatatgttaaatatgatgtcgttaaacagaaacacacataaaacaaggttatgtattgatcaactgacaaaaatgttgtgaccagaggctggaaggaacctaaccctatatttcctctaagagcaattttttcgtattcactaattaagtgtccaaggtgactttatagaacataactaccacaaataacaatcattaactgtacttacattgagtggaaaaatgttgggaggctattgtaggcaagaaaatagtttgagcaaatgaatagagttggataaattagtcattgtttaaaatagagaacaggcattgctaactggaatcaaggtgcaagagcaattgcagtagataaggtttaagatgccagattgtggggggtccattatatccagctgatgattttggactgaatcttgtaaatggatttggagcaaggatgtcataaaaacctctctgggagaaaaagaatttggtagggatgagcaggaagaattgggctgggaaaaaaggcagcaaggagagttctcgctatgcacccgcctcagctgacagggatttattggtggaacaggaagccagtcctctccaggacttgatggttgatactgaagccacagagtgagggagaagctgacagaggtgaagccatttcagggaactggaggaaggtcagggagaaaattcaaaataacaaggaaggcaatttaggaaagatccttaactgaatgacgagccagtgtaaattttgaagtctgtgggtggtgtggttgcactccttcatgtgtgtgaaaacaaggttctgagaagactaggcaaccccaggggtagccatggagactgtggaaaacaattccaaatatgtgtgtttagtttcgggagctggctcatctggatccctgtgtaatttaacagttatagcaaatttctaagtcaagaagaaccagactattccttgttaggcttatcttttcttagggctattatttgaagttcatcgttttccattcagtttcaaatcttgtatcagaacacacgtatgctcacacaagcacatgcacgtgcacacacacacgcacatgtacaagctgttctgtggcactcaatgaaccatgtcagtacagtacataacagctgcaaaaaaaagtcagcggctgctccgaaatcacagtgggcaatgtctgacatattgagagtggcagcttcagatttctgaggcgggctgccctgaagcaatctcttaatatttatcttgtaatatttccgttaaaattgactttcaaaaagtaagtggaacgaaactactcatgagtcactgaggttttatttttaataaacctggataagtatgcctctctgggtttttaatttcagaagaattaggcatcaagataagttaacatgacactcatgtttttcctctgcaactgaaggtttttcagtcttgaccaggaatctcaaactaccaatgtgaaaataggtctctcatcaggaattgagttttgccctagaattctcaaacttaaatacaatttcctcaggaaagactctccttcatcctcatttagaatcaatcattgcctccttaaactccttcagctcttgcctgcattagactatggtgcttttcatcatctgattagttttagcagtgtttgtatatgtgtcttttctcttgattgtcagcccctgcaggtcaaaagccatatcttgtttatctttctatatcccactctccctggtgtagttttttgctcaaaggaggtacactgttgaattgcttgggaataactcacccaccacagaaacatcggttctaagtaatccagttggtgttactagtcatctgaggctgcctgtaggtgagaatgagtttctcatcttctttgtaacaaagaagatatattttgtgaaataatgtctaattatttgaataatgagaaatgatatcaatggattaatcctttctgcaggaattttttttttttttttttgcctaagcaacgtgttatacagggcagcctcaaagattaacaaagaaaacgtggtaactctgaggagggtctactaggattacaggaatgagggttcactctttgggagggaaaaacaaaaaaggggaggaaaatgggaaaaggagagcttctttatagattatttttaaggtctcaattctgctaatgacatccacatgactttattttaattaattaattcacttatttattttcctgcacttcccagtaacaaacacataactttatgtctacataaagacatcc

SEQ ID NO: 1434 - DNA, 2403 bp, Homo sapiens
gttgtttacatgagattaatatttaaatcagtagactttcagtaaagcagatcaccctccataatgtgagttggcctcattcaatccattgggggccttaatagaaaaagactggcctcccctaaagaagaggaaattcagccagctgcctcccttcatcacttaaactgcatcatttcttccctgggtctccagcttgacgatctacactgcagattttggacttgccaagcctccacaatagtgtgagccaaagtcttaaaatacgtttctctctctctctctctctctctctctctctctctctctctctctatatatatatatatatatatatatatatatatatatatatatatatatatatatatatgtatgtgtgtgtgtgtgtgtgtgtgtgtgtgtgtgtgtgtatgtatcctattggttctgtttctctggggaactctgactaatacagtttccatcaccaacccattttcaatttacttcccattttaagagtaccatagaagccaccaacaagacggagtctcatttttcctccttgaaacattcacaaagaataagaataactgtaatttgggtaaatggaagcactccgttctctgtggtggaacacattagtctctatgacctcaagactcaccctagtcacccttcgcaccaactcaaaggcatcagattctgtaaatgatattgtaacaaagagctcagcaatttaagttctctgctctccactcctttattgaccagtcttattgactttggccaggtcaagagcttttcattgctttagtttccccatctgtttgtgtaatgcttatttctctgatattttgaactccttccataagcaggtgccccagaagagcaagtggggctattgatctggtgctacatgcgcaggaaggctccagttcacatgcctgaacccgttaccctgctttgtcacacattaaaagcctggagattaccagaagtatttggtttgggttgttctttgaaagatatgactgtacccacaaatatgcacagaatactcatcaaggactcttgaatcacaaaggcaagtccttccctcgtcttgccacaatctttgatggtgatgaagaatgtgtttactcaagttcacaaaagagaacttggtttgctctgttttagcaacagattaggattttcaaaagaaaaactggcaatataggtcatttttttttgaacaagctttgaagccatgctgaaatcttatcaggatgtcaagatttaaaaactcctacctgtacatctctctccctagaactcttttgtgcagctgctgccgcctcctttgttgagtatgtgtgaacagaaaagtagcatacactcagctcaaggcaccagaaaccactgtaagccatttctatctccttatggccgattgggcaggcaaattcaaaccaaacatgaattcctagggatgtattataatatatactatgtgattaaattgtgctggctcacctgcaatggatttgtacttgctctctctcagagcccccatttttcccacagtaatcttcctaaagggaaagcctactcactgagctctttttaaaaggcgagcaaatctcaacactgcaaccatttaatgccacagacatgattgtaaagagagcacaacaaaatgaaggtattgtattttcatcattcatcaacagaagacttatttgtaatataccccttgcaggcgggtctggtgtgtatattcatttattaggatcacacatcacattacctcacgtacataaccatttaagtcatgtcaaaagtcagccagcaagtaagctgtgatgaaaagatcctccagagaacaatttgcttcccttttacttttcaacatcatagctttgcctcttcttggtaatttctatataaaccaacaaacaaactctggtttttataaaaacaactcagggcatgttgcatgcttacattttaggatgttcgtagagtatgctatcatattttaacctcagagccttctttgagccaaacgggattcctcctaacctctctacctgtatctaaacaaacttcagatgagcacagtctgcagattgctgactttcagcatatcatcatcaacacagcaaaaccaaagattctccaatagaatctttcaaaaccagagaatccagaaagactcggacagcaggactggtggaccgtgaactcaagttgcacctctgatctaacttaatgcttacatatattttcaagaggaaaaactttgagcacacatagtataaaagttacttcctggtccacactgcaatacttttctcctactctcccagaaagctagagaaaacctttttaacaaataatacccagaaaagactttctgcagaagtactattttcc

SEQ ID NO: 1435 - DNA, 2518 bp, Homo sapiens
cacacttaatgcaccacccattactatttcataaattgacagcctttgccagtttcttgtactatttaatgtgtactaataatagttggtatttacttagcattttccactaaactccaacatattttcagatgctgtttaatttatccttactggttatatatttttaaaaacttacagggacattgtaagaagttgtatggaaagaattctttgatttttatattattataaagtcatgcattgattcaacatgtatgtattgagtgcctactatgcgtcaagccctctgttaatagggatagaacaaaaatggaaaccaacaacaatccttgttctcatgagtttgtaatctaaagtggaaaatagccatcaatccaaagatcatcctgtataaacatgagtttatggaaagttacaaaggactatttttctctttatctaaattacagcacatttaatttggaaagtgttaccatggtagcctcactcatgggatctcactgataaacaggtaccaacttcttttggttcctcattagctacattgctttgcatggggtctcagacaaatccaccttaaaataaatatagtcaataatgatgtagaaatggttcagaaacaaaagtatgataaaatgtatctttgtaagatgtggaaatattcaaccttgggaagatttaccctaattcttgcctgctcaatgccttatggaagtgtccaggagaagcagtaggaggtaggaaagataacacattccagagaagacagaatttgaagtgggtgggggaattataacttattactaccaagattatgagatagatacaagacaaacaagataaatatcatttgtaaattaataaagataataactccctaactgtagtgaataaaagagttatataagcttgaggagagatagtatgaagaaaacataagaaaaaataatttccagatcaagcagaactggccctactccaatataagaacatttaaacagccagtttgggggagtttgccccaggatatgctttcctttaggaattcctggaaacatgacccacaggtcttgggatctgtaactgagactctaatgacatcaggtcttgaaatggttgcctactctgcaattttctctgtgggcaatgtatatacacagagtgtcttatgaagccttagatgtcagctgcacacctacaagggtaagctcctacacagagggcaagcaaccctcaagaaagaaggccaaaaagtcacggtaaccatagcaaccacagtaaaacagtcaagctggttttgttaattcaaacaacaaatgcagcatccacagacctctacaatcccatgaattaagcagatgataaagcccaaatcttttcaatataatggggttagaaggtggaaggagtttccagtatattaatgaggagttatgagaactttgtggctctattaaaacaaagcttcataatttatgtagttcttctatatatattacttcatagatactttcaattcaacagtgtgatgaatagagtgctcttagttccattttatagattcataaaatgaggtttagtaaagatgagtgacttgcccaacattatataactagtaaggggtagagctaggatttaaatctagattttcggactctaaatcactaaatgtataaaacaacctcttacgatgaaaatgctagattatttacatagataacaccttttaagaacgaggtatctacaatgctgaacaacacgattttaaaaaggaaaagtaggtttcatatatatttatataatctcaacaagtagcataagtattcctttcactaaagacatgatttttgcttaggaaactacctccattagctgcatagagtgtaaggggaaagaaactccaagtgttttggagctaagggggatggatcaacagatatgtgtgacaggagactggaagaggcagagaagggaagggaagtgagaatggagaaagacaagagcatgatgcagggagaatcctcaagtgaaatatcctagtggtgaggatggagatggctatttctagaaaagagatgcttattgcatctaagagcacagaatctggagccagactgcatcggtttgaaacctatctctatctctaactagcgatgtaagcttgggtctatctcagtttcttcttcagtaaggtaggataacataccacttacctcacaggttgtttgaatattagccaagttaatacatacaaatcacaaagaacagcgccttatatttagtaggtataattttccttattgctatcattaggttccatttgaaattgtaatataagtacctcctataccttctccttcagttgatctttaacaaagtatagaacatacacacattgacttaatgtagttagaaaggaagaaataaaggaaggggctgcagttctcagtatgacagaagcaggggtgttaagaatttatgtgctgagaaagcaagacttttttggctaaggaga

SEQ ID NO: 1436 - DNA, 1961 bp, Homo sapiens
caaattagggtctgtattattgcttcagggatttttttatgtaaacagtacacaaattggttgtattgtgttgcattatggaaaagcagctgttttgcatggaacgaagtgccagatttctatctttctggccttccatgaccttgaaaattgacctttgagttgcggagcaggggagaggtcatagtcaccaagatgatggcagttgttttgctcatgtctggatctacaagtgctctctgggcctctctgtgtcttctttcttttctcttgacatttttccttactggcatttaaaagtaggtatataagaaacacccatgaaagcccccctgtatgaaagaaaacatgaaggatttgggatgcagtgagaaggccaatgtgtaagagccagcttctgtcctatttacttcatgtgtatttctcgagagaaagatgttccctttcaagagcctgagaccacccaggacagtgaaacagccttgagacagatggtctcctcaggtgggcctctttgggcacaaattgccttctctagaaactggctgggaaatttggtcacattgcacaacaggtcctggagattgaaactttaatacacacaaatttcagaaggcagggagggtagacttctagcaatctctcttgtatcttcctttcaggttctttctgtgctatctgaaccccctcttttaagttagcccttgattccccccagcaagtccctgaaatagttccctgacctacttgaaagtcagcttgcagatgtgagaatcccagctctttccaagtctctgtggttgccacattcattactcatgaaagagacagggagccccaactctccatggagcctctggtctttactttactttatttatttgtttattgattttgccacagctcatgctggagcccggggaggctcagtctttttgaccaagtctaaaaccctcacgctttgctagaaagagccactgggtctagcatctctatcaggctagagctgggatatttattttaaattattttttttttgatgagctcagccagaaaggtgtgtttatatgttttcatggatattcatacatgtatgatttttaaaacctgactatgagtagaggcaaaggaaaaaagttgtcctgcatgtgcaatatttcaacataacaataccaaatgtcaataaaaagggaaggtacttcctgtaagtttgtgaagggttctgaaaatagcttcaagcctaagccagagttaacacagttacacagccagaatttccatgaaagcatcagtacctagggtgtttgtgctagtaaaattgtgcaaatatctgcagcttggatgctttgctcaccacagcttgactgtcttgcacatagtgactcaagattccttggttcttatgcccactttttaacccccagtttaaaaggtggcagtcatgtaccttctaatgtccaaagatttttaaacctgtgctgtattttgtaaaacagcatgaaaccctactatgtcattaaaccaacacactgaagggcttttcatcattctgtgagtgtgtgtgatgtgtgtgtgcacacatgcagatgcagacttgggagactttcctctcatccacctcactgttctctacattgtaaaaaaataaaaactatttattaatatggttaaaaacacttagattggaatgatgattttttaaatatctttacttaaattatctcattgaatttttgcaaaaatcaagagcaatagagaagccagaatgtacagtattttcaactcagagatgaggaaatgtagagactcagaaatgtaaaattgagtaattcctggattttcaatttcatggactactaaaaattttaagactaatgaagggggccgttttagaataatgaaattaatatttttccaaataagggcattaagtaaaacagtgcttatcactaacgatgatg

SEQ ID NO: 1437 - DNA, 1689 bp, Homo sapiens
caagcattattcccaacatggaacatacactatgataagaaataaatagacttaaagtgcatgtcttggaaaacttgaatacaataaatatattatcaaataaattgaaaaggccttccagaataattccattggggatgttttcgactctttagtttcagggataagtgctcttccacaacagtgctttcgatgtttctcttctctttttttttcttgtttttgagacaaggtctcattctgttgccttgggagtacagtggcatgatatcatggctcacaacaacctcaacctcccaggttcaagcaatcctcccaccttggcctcctgaatagctgggactataagcatgtgccaccacactcggctaattttttttttagagatggggtttcaccacattgcccagggtggtctcaaatttctgggctcgagcaatctgcccaccttggccttccacagtgctgggattacaggcatgagccaccatgcccagcctctttcaatgtttcttgaccataaccggtagcaatgcacttacatgacaacatacacacacagtttacctaaccatattgcagctggtggactttgattgtttctatcctatttgcttttattttctggttatgatccactaaataaacttcaaattccattaattaaaaacacatcttgatatttttaaaaaatcacaaaaattgttccatgtggatatcaggtggcaggagtcacagagcaaggttgaagattgagcagaaaaggattaaaaagtgagtagaaaatttggcccacatgggatcaagataccccagcctcagcaagggcgagaggatctggaaggtctaagcaacaaacaatggttattagcatcaagcataattctggtgcaggcagttatcttcgacccagtatattttcctccatgaaaccacaagagtcctaactagatgcacatgataaggtaaaatttattcctgcttacagttggaaaatgaggaagcaaacagttcccacaagagcagagtataatttaaacatctaaagaaaaagtaaaatatcattagctaaagtgaatatcatatataacaggttatcccggtgttaataaagtacatggacaaataagttcaattaaaataaaaggaaataatactgaatgacatattatttgctcccgaatgtctgaactgaattatttctctctccatttttttcaatcagtttctctccaggtcagtatagtcattgacaatctctatttctcttgaagatgcaattcctctttgtttctgtattccctggttttctaccattaagaaggctttgtttctttcgaatttgagtacatattctccattttgctaacttggggtggtaagtgcagccttgagcttacattgttcaggccattattttttttatttctctctcccccagtagccctttctttcttcagctgttagctattggcagaaagcttgagcatatcctcctgtgggtttgctccttaggggactttccttttgcagttaatccacagtgctaaagcacaagcctctctctgttcttttgatgttacttctttgcaaaatcttttccctctgtacctaagacacctaagctacagcacattgtttggaatttacagggaaactgttatcactgctagagtatgcaccttgatt

SEQ ID NO: 1438 - DNA, 1737 bp, Homo sapiens
ctcatattatgtaccagctcttagcttccatttacttaaggaggtgtgtgttggtttctgctatttgcaagcaaaaacagccctgaattcagcagggctattttcaaagtaattattttgagtagtttcatatagcctaaagtttttcgttcaatattctttgatttttaatgttcagaataagccaaaagagttcctagtctattaccaagaccttcctagtaaaataaaaattaaaataaaaaaggtaaactctcttggtttttttctttgaaaaactgctctttcatgctcctgggcagagttcaataaaaactcacaaagcagaaatgtcacctacctgagttgtcaggccactagccagagtagctgtcaattaatgttccctgtcttccctttggaaagttgagcagacaagctggcaggaaaaagtccagttaccttcaagggtcatccatctacttctaagccaacaaatacctgcgtatcttgactccacagctgagatcaactaaaaacaaaccaaatgctaaaaatctttgcttcaaaaaataaaaaacaaaagaaaaaggatgccagtttagacagcagccagcacctggctggcttgctaatggagtgctgggaaccaagcctccgtccactcaccgtattcattaggcagagagaaattttcagatagattccaatgattggtggaaaggctctgagaaaaggatggcattccactctcccccatccaccctccttttacttacctccttttacttacttccactcctcactccactctcctggcaactgttccagaaaaaggagccgggagccacaagggggacccaggctggtctgtgtaagaacaggctgtgccaggttttcagatgcaattaattttcaagataagctctaaacttctgaaatgtctttgcaattgaaatgctgatacagtcgtcaaccactgcagtacataatcataaatcttgagcacagatagtttttgttggtaataatgaagtacaatatacatttaattagtgtgagatttaggaaacgtgcagtgtaataaaacaatattctaattagggttggggaaacgtttaaatactatttgtgcagtaccgttcaatgaaactcttacaaactacactcaaatctgctgtttctaagcaaaaaaaaaaaaaaaaaaaaaaaaatcaaaacagaagcaacaagttctttatgcccttgaatattagttgcagggacagcactagattaaaaacaaatgcttggtggtcatctggagtaggcagctcagggggaaaagggaatcccagtgctaaagtgcttgctagatttttggtaacagcccaggctgtcctcacaccttcatttactgtcctattaatttatgcttcaacctccccaacatcctgctcaaaacccgtcatctgttacctgggaatgccacctgtgcccacgtccagggatgctgggattattaatgatgcatttcctaagagtccccaagtccttcaaaagaatgagtaatctaaactgacaccacgaaagaaaaacagcctaacgaaagaaaggtgtggaagtcaggaagcctagagtctaatcctggccttaattgtaattttctgtgtgtccttgagaactaattaacatttctgtacttcattctcctgatctgaaaactgagaatagcaaggtttcatttgggcaatgttgtataggtctgagataattcct

SEQ ID NO: 1439 - DNA, 2780 bp, Homo sapiens
accactgcattccagcctgggcgacagagtgagactccatctcaaaaaaaaaaagaaaatgcatagcacttaggacctggcacatccctggggtcaaaaaacacgggctattgttgtcattattacgtacttatttacttagggttcacaggcctgacaagaacctttgaagttcagggaatctgctcatctggctttacccatgaggaagctgaggaccagagaagggaagtgacttgggtcagaatcagagcttctcttcccagacttcctttcatccaaccaagggtcttcccccaagaggtcctctctgggccttagtttcttcaattgtgcagtgaagggattagagtagatcaggagtttccttttttgtcatcatcattattattactattattattgtattattattattgccttagaacttcttttcaaacaatcctcacttagaatcgcactatgcaaaagtggactagatctggagaaaactgcaagagcagggggtgggatggtctagagcccctctaccccagcaacaacctcagaggcctgtcagagaaaccctgggaggtcacagaccccaggtcaagaccttggccggggtgatgtcagggcttccaccactggcactctaggaggctggtgcccccagaagaccaagaactctccaaagccacactgggagaagaggagaggccttaagaagggcttcctggggacaggattatcttgacaccctctctatacagaaaaggggtggaagaggcagggatgcagaagaacggtccagagggcctctgcggagcagcttgttctacctgtccagggatcccacacctgatgtgcctccaccttctctctgcttcccagttctgagctgcctgcactcctgccatagttgcagcccaagaaaacatggccataaaacagacatttgctttagttgtcacttgaaggggcaatttagcacaggctatttgcaagctgttggagttctttacgaggctttatcatgttttcccaaagtgctcccctcgaagcgaattcccaggtcaaagttcacacgtaactatttagggggaagagggagcatgggagattgtacagactggagaatatatatattttttaggtcaggtcaagagtggctgaaaaataagagcaagagaaagccaggccggcctctgattgaggcaagtgctgtgtgaccttgcccaaatattttccctctctgggcctcctgcaagcaaaggccagtctcagtggtaaaaatgaaacatgtgactcagccccagcctctagggccctcacccttgcaatgacccagatgctgtgtatttgcagccaaatcacactcaatgagtcttgacttgtactctctggtttggatctctctagctcttccctcccgccaactaccgcccccagcaaactgctgatccttccctgccatcaatttcccccacttggtttcttcacttgttttctggggtccttcttccctaggagaaagggctaaattttgctagacctcccagctgctccaaggaggggaaaagtcaccaactccacctccttccaaagttcatgtggtttcccccctcgattttcccacagtccttcccctcttccctccagagctctaggctgagtggcatcagtgggaacaaacctctcacactgtaaacagagcggctttcctgaggctggatgcaaggtccttggagatcacacagtgggcaggggctgggaagctgggaccctggggcaccttgaacatacaccagttccccttcggctccctgcaaagaaaatctcccacctctaaggccttatggagactgggacatgggtttgggggtacactctgaggcctgcatccagtgctctcccaagggtgacttgggaagtgggggtgagccagaggtcataatgtagaataggggtctcccctcactcaagaccccacccccttccttacatttctgaggaactttcctggcctccacggacaattccagcctcagtattcccagggaagggtaatgaggcaagtgggacatttctcaggctgggagagacccccaaggtcagggtcagatagaaggcaggatgtgtgggaggcagaggagtcaggaatatgggaatctggggtggtgggaaatcctgtggttcctgaagcagcaacaacatttgcaaaggagactccaccagaggagctgcctggaggctcactgaggcattctgcagcccagacccacccgtagactaccagtcagggactgcactcaggcctgataccaagccactggggctgatgtgaagggaggtgagtacaggttctcccaggcaattatcaagaggaaaagaaacagagcagagaccattagggaagaaatgagaagggagaggggccccagacacaattctccaaataagtccttctgtgtactgtgtgtgaattaagcttctgcctacctaaagtccaaaggaatcttgtaacgtcaatcccatttttcatatcaataaatagagggtgcaagaggcaaaggaagtagcccagatcacatgggctacagatcaaatgggcctggccatttatctagttaccaccccccagcctcctcacctgctgtgttgtaaggggctacctatgcatctatttacatctggctgatagtctccattctcaccaccacaaaaacagaatctcagagtaaggaggtccaacctccccatggtgcaattagggaactgatgcccagagaagggaagct

SEQ ID NO: 1440 - DNA, 1928 bp, Homo sapiens
ggaagactttggaagaaatttaacacccaatttgggaaaatcaacaataaataataccaaaatattcattttgggattaagccttcaaacatttgtatagggagtctgaagactaacagttatttcactataccaaaaataattgtagctatcatgagatactctccaggaggtaaggggctttgtttttctcatatttgaagaacattttttatcatgggaaaatagaagttgaaaatagtataatgaagctccacacgctcatcttaaatacctattaacatgtcatcatacttgtttttatttttattttttggttgaagaactttaaagcatatccaggaaaatctgatactttttgtgcttaaatagttcaatacatttacacatctttaaaaataaggacattttcttcataatcactatactactgtagaacccaacagtattagcaatatttctataatattatttaacacccagcccatacttggaatttctccaaagtgtcctttttttttttttaacagttagtttgttttaatcagagtgcaaataaggtacacacatttgattgccatgtctcttgactccttttgatttataaaggtactcttacagccaccactcctttttaacacatgccatcaacatgttgaagactgggtcatttgtcgtgtagaatacttctcatttgggatatgtttggttgcttccaaatgatgtcatttaacctatccttctttcccttgtatttcccatgaattggaagttagagctagagtcttgattaagttcagattcaacattttcaacaaggatacttcatagctagagctgggtacaccatattacaacctatcagaagcacatgctgctttctagttttagggatgctaagagtgatcatctcgtacttctgtaataaagttgcagccccccaccccacactgccaccacttacttatgcttatgtcaaatcagtggtttgtcactttggtacagttattgttatcctttcatctaattgtttttagcaactattaaaggttgcttaagcaattatttcattagggattgcaaaacggtgattttttaatgcagtaattcttgctacatttattagttgaaattcttctacagagtttttttctacctaaactagaactatttggtgttctgaaatacttttttttaaataagaaaggcaagatgaattctaaattcattctctttaaagagattttcttttgtcttttaaaaaaagattcatcatggatttttatatagtcagtgtattccaaccaatcacaatcattattcattttgatgctcaaattgttccatctctggccagttgaagcccctttaagttgctttcaaacacttttgaagagtctcattaaactttgatagcttccttactttctggagcacaaaatgctccaagctcatcttgtatgtttcatgccccagacctggaaacagctttttcttttctttttttttttttctttactttaagttccgggatactctgcagaatgtgcaggtttgttacataggtatacgtgtgccatggtggtttgctgcacctactcaacctgtcacctaggtcttaagccccacatgcattagctattgtcatgattctctcccttccactgccccctcaataggccctggtgtgtgttgttcccctccctgtgtccatgtgttctcagtgttcaactcccacttatgagtgagaacaagtggtgtttagttttctgttcctgtgttagtttgctgaggatgatggcttccagcttcatccatgtccctgcaaaggacatgatttcatttctttttatggctacatagtattccatatgtaccacattttctttatccagtctgtgattgatgggcatttgggttggttccat

SEQ ID NO: 1441 - DNA, 6340 bp, Homo sapiens
aaaaagacaaagaagatcattagatccagaatttacagaggccaagaatgcaatgatttggaaggtagactaaaagaaaagagcaaataaataagagccagtgatgctcttgtaggagggaaaggaatgggatcgagatttttatctattggaaaaaatggtataaatcagatggatgtacatgaactaatggtgatacatgccatggccaattatgtccactgatgttcaaaagaagcaaaataaagcaaggtgatgggaaggggggatatgtacttagaaggctatggggctaattaggaagcccttggattgttatgaagcttgccgtattatttgtctaacatactgatgcagagatatcctaataactacttaagggagttatataaatgagtgaataagagcaaggacgttggtgtcaatgagacatgggttgaagttcttactatatcttgtgtttgtggtcttgggggaactgcttaattcaagctttggttcttcctttttaaacatcacattatagggatgatatgaggatgaaatgaaataatgcatgtaaactgtttagcatagtgcttgccacgtgatactgtcaagaaaagagcatgtttggaacaattttcaggtctctttaatttctctgacaatgcctattatcattattttcacttcactgcatatgtaattctgggtcataactttattcctcaaaactgtcttgctgttttcccattgtcttagaaatttacagttgcagaaaaggatgaaagatgccagatttatttttaggacacctgtttcctcagtttggattaaaaacatatattttctatgtctttgaattccaaaaattttgctgaaattcatgtaagtatgggtgcttttatcagtagtttaatctcaaacatgtgtgacctttcaatctacctatggagttctttctttagctcagaaaaaagtttattatatttttgttcagtgctttgtttggttccatttttatccaggttttctaacataaatgtttgttttttacaaatatttcgtgagcagtatagaatacagtttcttctttgtgtgtgcacgtatgtgtatgtgtatgaaatcagcctttttaattacacttatcttctatgttcatgtttgtttttgaccatttgatatttgccttccaaaattttaattagctctctctaaatttgataacttgtttcttcactaagaaacaatttttctacctttttccaatacttgaattattaagtaaatgttgatgtcactaagacatattgaaagataaataagccaaatgcttttgaattgtgatctatttaagaatgtgtcaatattaagttttctatactattgtgattttgcctatttctcctattaacaatatttaatgaaatacgatttagggcataaaagtatatgctatcttaatgatttatcctttatcatgttaaaatgtcactctttaaaaactatctatttgatatttatttttaatgtttctggtattgagtttcgaatacctaaacctattatgtttgaatttgtctaaaatatgtttgtctgtcgtttttggatttttgtgatgttgttttagctttgttctttgtaatcagcatactcatgtaaacaccaaattttgtcttttgattcagtttacaagtcttttaacaaggaataattatccattttatacttgaaaagttttaaataaatagtgcacgttcctgtcattttgtcctttttcttttttgtttctctatacttgcctctatgttgcccctttaaaatttttatttgtcttgaaaaaaattttttttaagttacagtatagtacatggtttattatcttttatgtcttccactcttttggaaagtataatttttgcaaagtggcttcctttaaattttcaaacgttatgtttaatctctattcagctcattttcaaagttgagtaaaatatttgagtggctccctttgagatatggtgtttaacatgctataattttcttctatctcttccttctacctccttttcaatataacatggaattttaaatgcagataatttgtataatattgcataattttacactatactttttaaataaatggactgatattaattctttaagtcttagctcaggtgttgcctcccccgcttatgccccctacttcataaagtctctcatatttctttttttttaattttattattattacactttaagttttagggtacatgtgcacaatatgcaggtttgttacatatgtatacatgtgccatgttggtgtgctgcacccattaactcgtcatttaacattaggtatgtctcctaatgctatccctcccccctccccctaccccacaacagtccccggagtgtgatgttccccttcctgtgtccatgtgttctcattgttcaattcccacctatcagtgagaacatgccatgtttggttttttgtccttgtgatagtttgctgagaatgatggtttccagtttcatccatgtccctacaaaggacatgaactcatccttttttatggctgcatagtattccatggtgtatatgtgccacattttcttaatccagtctatcgttgttggacatttgggttggttccaactctttgctattgtgaatagtgccacagtaaacatatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacttgttgtttcctgactttttaatgatcgccattctaactggtgtgagatggtatctcattgtggttttgatttgcatttctctgatggccagtgatgatgagcattttttcatatgttttttggctgcataaatgtcttcttttgagaagtgtctgttcatatccttcacccactttttgatggggttgtttgtttttttcttgtgaatttgtttgagttcattgtagattctggatattagccctttgtcagatgagtaggttgcgaaaattttctcccattttgcaggtcgcctgttcaccctgatggtagtttcttttgctttgcagaagctctttagtttgattagattccatttgtcaattttggcttttgttgccattgcttttggtgttttagacatgaagtccttgcccatgcctatgtcctgaatggtattgcctaggttttcttctagggtttttatggttttaggtctaacatataagtctttaatccatctctaattaattttcgtttaaggtgtaaggaagggatccagtttcagctttctacatatggctagccagttttcccagcaccatttattaaatagggaatcctttccccattgcttgtttttgtcaggtttgtcaaagatcagatggttgtagatatgcagcattatttctgagggctctgttctgttccattgatctatctctctgttttggtaccagtaccatgctgttttggttactgtagccttctggtatagtttgaagtcaggtagcgtgatgcctccagctttgttcttttggcttaggattgacttggcgatgcgggctcttttttggttccatatgaactttaagctagttttttccaattctgtgaagaaagtcattggtagtttgatggggatggcattgaatctataaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaagttggattcttaggtattttattctctctgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttaacttcctcttttcctaattgaataccgtttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaaggttgttgaattttttcaaaggccttttctgcatctattgagataatcatgtggtttttgtctttggctctgtttatatgctggattacatttattgatttgcgtatgttgaaccagccttgcatcctagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcaggatgatgctggcctcatcaaatgagttagggaggataccctctttttctattgattggaatagtttcagaaggaatggtacaagttcctccttgtacctctggtagaattcagctgtgaatccatctggtcctggactttttttggttggtaaactattgattattgtcacaatttcagagcctgttattggtctattcagagattcaacttcttcctgttttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctcttttcttctttattagtcttgctagcggtctatcaattttgttgatcttttcaaaaaaccagctcctggattcattaagtctctcatatttctatgtggacttaatcatgtcttcctctttgaatatttttcatgtgttctttccagcatgttccctattggcatcataattactagtgtagacatattgctggcattgtagaagagtcctgtatatttaaactaccatcagaagttttatgttgttgaatagaggtcacataaccctgctttttggctaatattgatttaacctggtaatttaaatacattcttagtatatgtttattctaattgaaacctttcctttcatcatagatgggaggtgaggtatggatagaaggaatttcaaatgatttggatttgggtttgatgtgttaagctcactttctgatttatctgctccacaagtgagatgttttccaaggaaatcaagcatgacgcttgtgtcttttgataccctgtgctccgatttcaaacatgatgcagctgatgctgatgcccccatcactgagaacaagaattctctccctgaggttgttagcattactggtaccactcatgactttaggcaaaatgcttattgataatgtcatatttttactcttaaggaaactaaactcattgatttctagaatttatctaaatgatgctacaaagtttcaaacctatgtttatcataattgataagaacatttcataagaacaatttcatttcaagtgtaaattgctgagcaatgcaactccaagcattaaattcaaatatcagcaaaaatgtatacgtgtatacaccatacatgtttgtagataataaagaaaaatagactgtgtcctgccacatcatatttattatgcaagttacttgtaatatatttaagtacaaaaatgaagctttgagataaaaatttaaataaataaatacaaggaaaagtagtagaaagtgagtttttctcagccacactttcccaattccccattaacttcagtggtatcagttaactcctctttctttccccactgatccctaccaaactttaagcctttgaaattctactctccccaaagaaggaggctatatcctttgcttacctgcttcccttagctaggtgagacaggtttttctttatgtcttttgttcacatactaaatctcaactatatggagaggcactagagttttcacagacat

SEQ ID NO: 1442 - DNA, 5891 bp, Homo sapiens
ctcagcaacctggacagagaagttgttttcagttcattacatacaaccttctcagcatgatgtgaagcaccatcaatacgtcaccttatttactactggaaagtgggatcatttcattttattatactgcatcttgtggcattttcctcgctccaattttacatgttggcatcattagttttctttttctgggcaagaagtttgctgctcagtaaattgcttctcaggctgttcaaaactgactgttttgaatttccaattgttgttttaaaaaatcaaagcttttacttataaaatggctgtgagtttggtggagccattggtgcatttgaaagttgttttccataggccatgcacaacagaatagaagatgtgaattatcaacccatataaaacacattgataagtaaccttccttgcaaaaacaggtgatcttgtgtcccttgctccactactgcagtgaagtaacatatataagattttagtttcgcatcaataaccacattaaactttcccagaggcacaggcctagaattttcctatctcacctctcatcttcaaaaattgccctattggacttcaaatatgtttgtaaaacacaaatgctaattaaacataaaataaaagggtgtaacaagtaactaaacaaaaaaattgcaaaaaatacaaaatcttcacaacacaatttacttctttcaccattgacattttataacacttgccacaaccacaaagcaatggaagaaggatagatagggggtgagtcaatcaaccagctgaatcatggcagctttttagtatagaattccttttttagaatagaaatgtctatcaagcctctacacttgcaaacactctctcctgtttgtgtacactttggctacaatcaaatatattgatgtcatttaggtcttgcagtgttgataaacatgaggaatgaaagaagacaaattctgtaaaaaaaaattaaaataaaagtaaaacccaagtatttcacacattgcttaggaaaaaatgacaaaagtgctggagggaaaattctctattatgctagcaaatattttttggttcccatatttccaatgtgatggaattgcgatgtgcaaacaccactcttggaactatatagaaaagctaaactggaaggcaaggaaagtagattctgctattggctcttccaccatctatattttggttctttcattcataagtcaagtcacctacttgacttatgatatgggaattttaagttccaagattccataattgttatccttggtctcaagaggatgcatcaatgtattaaagaggacaaatttctcccttaatcatacattcagacttttgaaaacatcctacctaatgctacattggaaaattctacttcatctgctttgctccttgtaaatgaggaggtatgattttctgaactgggtatagagtatgaagaagttaaccctttgaagttgcagagggaaaaggttacaggaaaagtatcatggaaaatttggaataactatggtgataaaatacttgacatcacatcttcgcactattgttttgccttaggttccagattctgcatttttacatcctggaaaagatgtgggaaaaatattatttgaaatatgccttgcacatggcactcagcgtgtttatctagggcagcgtgtggcagctcagtcctcctgcaatacctcaaactgcacaactaaatagtcagcatctgttatactcccgcacactttattgttgattggaagccaaaaaaaaaaaaaaaaaaagctgtggcttcttcttcacacaacagaaggtaaactattggcactcagatgctaaataatgccattataaagaatgttatgtatgaaaggtagttaaaaaataaactcatgtaccacttaaagaagtttgttttataaggttaagctatggtaaaaacaaataactgctcgttactttcaagtctctctcaagtatattaatcaaaaaagtagggacctcagaattaaaattcatgttgtacatttactttttgagtaccaattcacacagatttgccccttaacaacactggattatttatattcgttgacataaatgaaagctagaatgtcacctcatataatctctccagccctaaaattgtatctaacattaaaattaaaattttaatggttgaacttggatgatactttgacaagttcattaacagtgactacacagaggtcaagtgataataaatgtaatgtcttgtatgcttttatgttaatatgcctaattggtagatgaaacctccactcaaagccatagtcttacaataaaattaacctcaataattgtcataatataaacccaagtataaaagagttaataaaaggataagttttgaccttagaagagactaataaagtagaaaaacttcactgtcaatcatgctgggtttgaatcacagctccatctcttgcatgctggacaagttatagttctctcatcctcaatttcctctatgtagaaggaataattaaatacccccccccccattgagtattttgtagagtaaatcacatatgtgtctaaagcagctagcatagtctcgtacagacagagtgctatgaaagtcaccttcatctactgctccagattgctaagctctctagagtaggtcagtatcccattaaccatcatattctcattgtgtaatgttacatctggcatatagtggattttctctggttaagttgttcaactcaccttttgttttctatccttcaggtcccatcaacatactctaaatataaaagccctatgtgcttctacgtcttcttcaattatttcctcaaagaaagaagtgaacaaacaaaataacatatatttagaaagaggttaacacttagttctctaatcagtgacattctagagagagtaacctagcagttgtctctagtgacttctaggttcactgtcatgaaaacctaaatataagtactaatattctgttaatgctttactgagtatgcacaagaggaaaacacatttctcctgcctatgcagcttcaataattatttcctcttaatgtctcttgattacgtggcatagatataaaatacaacatttggttataactctgcaaggtgtatactaagagttggtaccacgtctgccaccagaagctggatgtcagtgaaaatggcatctaattacaaaagttaaatggtagccagaatcccctttcctctcttttctgtatatgccagttagcttacattgtttatgtgtaagattattttttttttttaagtttctggagagttttttaactttcacacctagtgctccggttcagcgctactgtggtggctccgaggaatttcacctaattattactgagagcaaagcaggaggagcattctctcttcacccaatttttggtcttgtaatattcaggtcctgtattcaagggtgttcagcctagtggacacatgtgatgaaatccattccacactccatgaaccaacatgtgcctgtcaaggctatgcctgcctagcagaaataccttgtcacaatttcatgaaacagcctcccgggctaggatatccctggtttctctgttcttgacccagcacttgagtaagggcagctttcaatgtactttaaatggattgccttttaaatgattgcaaacaattcttgttgtcaagtcgttattgttattcatactaaaatcttttttcttccccatatcctaatttgtagcagtgccatcttagggatgcagaatttttctactttgggataaattatctgattacgtacttctgacaaaaattcctcatgcaaacccgctttaaagtaaaatggtttcataatttttgttggtactgacattaaaggtattaaatatattttaatggttctctgcagtttaccaccttctcttcttcccagtaaattacatacaaaactgggaatatattgcaaaaataacagaggtgagatatacatctatgtattaataatccttccttccttcctttccttccttcccttcccttctcttccccttccttccttccccttccgttcctttccccttccttccttccttcctttccttccttctttccttccttccttctttccttccctccttcctttcttctttcttttgttccttttcagccatccatccatccacccatccatccacccatttattcatccatgtatattctttggctttccagtctggtttcttaaccactataattctggactacctgagtaaactgttcttcattataaaagaattgtacaggggaagcaattgggcaaaccaagaattctcacgcagattgtgattgaaactcagtgggatagaaagacagcactttgattaggagcccttcattgtatttaccatttctactgtcctttaaactttatcctggccgggcacggtggctcacaccagcacgatgggaggccaaggcaggcggatcacaaggtcaagagattgagaccatcctggccaacatagtgaaaccccatctctactaaaaacacaaaaaatagctgggcatggtggtgagtgcctgtagtcctagttactcaggaggctgaggcaggagaatcacttgaacccgggaggcagaggttgcagtgagccgagatcacactactgcactccagcctggtgacagagtaagactccgtcaaaacaaacaaacaaacaaacaaacaaaaacaccttatcctccaacatagataatgagagtattttgtaagatgcgaagaccatatatgcttgggaagcttacgccgaaatacaattatataacctgggtcattagtttgtgataaaaataacattgtacttattttaaatttgaagctattttaccaaattctcctctctcctctagtgagaatacctttctttccttcaaaggatgcctttcctcaagataattgaaagcatcctaagggcaacctcattccacaagtctagttttggtccctagcctttccactggagagggaagtttgatttatccccgtggcaatggaggactctaaaacagctactggaggctgagtgccagtgggatactctgtggttgctaagcctaaggtgggcatcactgctgactcctagagattctacagagaaacctcttcttcattcgctagaagacattgttactatcagtaaggttaaagggattgcctgcctccccactgaagttagatgactcacattagttacttgaatttaatttgtctatatttcatgtggataaagatcacagtgccatagctctttagagacacatatctctcaatatgaacatagtctttctctctttctcaccctctcttacatgattttttcatgatgtttcctaaatatcccccttgttaaaataaaataagtcaggcatagtggctcatgcctgaaatcccagcactttgggaggccaaggcataaagaaaacttgagcccagaagtttaagaccaacgtaggcaatatagggagacactatctctataaaaaattttttaaaagcaggcatgtgacacacacttatagtcccagcaactcagaaggctgaagtgggaggatcacttgagcgtgggagttccaggctgcagtgagtcaagattgtaccactgcactccagcctgggtgacagagcaagactttgtctcaaaaaataaataaaatgagccaaatcaaagggtcctatttttttttttcagagtaaaaataagaggtcttccaagatctgtgcatccacaatcaatcgttttgagtgacctcatgtcctgctaccttgttccctctataaccttctcacttctctctgaggatgccaaacaccaccc

SEQ ID NO: 1443 - DNA, 3476 bp, Homo sapiens
ttaaaataaataaaaacaactccctagatgaggatttgaattaactattgaaaaacacaagccatgtttacctgggtcatgccatacctgctaagacagtgattgggctgtgtttgtttagagaggaaataaacaaaagaaacactggtttttcttttattatacatttttttagatttctagaaacgcattacatgacatttttgaacttttcaacctgtctttgtggcaggttgctctgtgggaaattgcaagctttgaacttctgcagacttctttgtcagttactggttttgcggtctgaggatgattaccaaatcactacaggccttgctttctccatctctgaaatggggattaagtacctaaattatggactgctgtgaagaataattgagataaatatgcaaagctcttacagcacagtagttgtataaaattatgcagtaattttacaaaataactttgcttttgcatacataatttagaaaatagtttattaaacaacacttacttccattcctttggcattgttgattctttctgtcactggtacctcggtagaaatgtcctccatgcatagattagttttgcaaaacacacacacacacacacacacacacacacacacacacaatgcttttttaaaggttaggtatattttataaagcacaaaaacaattttattcctgttgataaaaaatctatttcatgcctgtcattatgccttttaccatcatctttgaacagaatttaccttaagtatatctttattttttaggtcagtccgcctacacacattttctatgctttcatacagcggctttcaaagttcctttatttttagcaatcaaaaccctgccccccttttcaagcaatctattacacagaacctcaaaatataaaaatgatgtaagttgaccttttttaaagctgaaataatgaatcgacaattttcttactcacttttctctcttccctgcctgcccacctgtccccagcaatccctgagtcattctggacaaactgggcacagcaaaagacaagtgaaaactaccattttcatcaacccattttgtgctcttcagctacggtgtgctttcatagtaatacaaactatacccaacatagtaacaccatgttgagaaaataaaatcactaaatatcacttttcttattagtgcactcaaagtgtctacattatctatccatgttcatcactggatgcagcatgactccaggcatctttctgcgctattacttgtctgaattgttatcctcgccaccacatgtacaattttaacttcctttgttaatctttaccatattcctgtaaacctgcttctctagtttcttatggtcattttaaatatcagttctacactgttctgtaaaactgccgtatgtacagactttctgccttttcgtggccatcatgttgaatttgatatgataccgctgaccactaaaactaatgaaaaacaccaagttaatttttctaacaactgttgtttctgtgtgtttttggtgtgctttaaatttcactgtgacaatcatctgcaaataactcgagaccctcctttctatcaggctaggaatacagctctcatatgagagaaaacctgcttccattcttctcctgcccattcaccttaaaaccatacacagtctaggaacttgctgcctaccaagtaagaggaaaagcattagcatttatacagtgtttaaaatgaaaacaagcacacattgccatcaatttgctgtatcatttttgatcactagaacgtcctccttgggaacctttaattacaaattctgcattttggaaagtcataaggcattgctggtacttccagtagtgacaaatataaagttgattcaaatgaacaaaatttaggtttctgtctctatacctcattagcattagcaagttccagtctcatagcaacccagatctgatgatgaacacctgccagcccagatggtttggggagaaaattcctagctaaatagaataaagttctgttgttgggctgtccaagctgttatttaacagggatgttgcaaaaactctgaaaagctattattgtagaatttaaacaaagaaacatctccaaagttgtcacttgcaatttccatcacttctaatatctaatgtcccaacaattttagtttgtgcaaataatatggttattctatctttagacatactacaaatggtattggatgtccactggcatgaacacagcagtagagcaaaatcaatagcatctgcacaattataaaacaaatgcttgtattttcatatttgcttttaaataaatccagtcctgttccttcttctaatgaattggctgatatacaaaaaacaaaatcttctgaataagatcttaagtaaatattgagttgctacttcagcccacagtattttctccctcattcaaactcttagaaccttactgtttatgctgttttgttggaggaggaaagcaggtgctaggggagatatggctggatgtgaagtcaagagcactgagatattggttacccttgctcagtggctctttttatgacctgattgaacccattaaactaaattttcctgcccgtaaaataattttgtagtaaagactacttagattttttttagtgtcaaaatataccatatatcaccatatatttttatatgtgcatagattctttacacaaaaatgaactactcaggatgaagactgtactgtacatctctaatttgtggtgcagagctttttacacaactgatgcctaaggactatcagttctaccattgctttcaccttcttggtgaaaatgatgaagatcatggacttgggtagataattttctgttttctagctctgtgagcttgggcaaattacttgagagtattgagtctctatttcttcatttgtatttacttcatagggttgataagagtgttagagaattagcacctacagtttacattttgaaaacatgatttcctgtgcctccctgccctgggttggtaccacagaactttgcaaagagtcaacactgaggtcaattcattgtaataattaagaaagccagaagatcaaggttcaaatctggttttaccacttagtagctgtgtgactttgtgcaagtttgttaatccttctgtttctcagtttcaccaccttcaatggaggcaatggtaatattcacttcataggattcatgaaaaataaatgaatacttatgaattacttaaagagtactggatacataccaagtactacttaagtttaggtgttagttttaactttacaaatatttattaatcaggtttacaagaaaaatgctattattttaatatggatttaaaacttctatacttgatactgattatgttcaagatgaacataattattctcaaatttggtggattgtataagatgtacattctataaaataacaaattaatacatgctttt

SEQ ID NO: 1444 - DNA, 1283 bp, Homo sapiens
tgccaataaatattaggtgttattaggcctgggaaagctaattatggctgtttatgcccttatatatcacactgttaatactactataaagcccttatcataaccttcagtttatttcctctgagctacttgatataaagactgccttctttatctcctagcttttaatactgggagataatacaattcatactgcattctgcatactcaaacatatttgtagaatgaatacattgtctcctttggattttaagtctgccgcctggaactatagaacactttctatttcttaataaattttgtcattacatatggctttaaaaatctgtaaatgtattttaagcaaaatatagtattgtctctatcagcttaattttaacttttgaagacatgattaaaagtataaataaaagtttagttataagagtttgcaaggctaatatgtaatgatttggtctgacagctgttgagttaaaattctcatctttattctaataaatgtttctcagacacattcaaagagaaatttgctgctggtgcttcatgaacctttataagtaaaataaacatcagttatgtagacaaaaaacagaagaaaaaaactgttactacttcactaagttttcttctaccaaaggacagattgtcattaataattcatgttattataataataaagtttatggtaataactaacactaactttgctcacacttatttccatttcccagtagattaatctactcctgatttttagaggaaaaaagtagtggtacattttttgccaatgcaaaaatcaggagtagaatagtaatgtcttgtatttgtagagccctattcagtttataaaatattttttaaattcctgatgatataaagaatatatattttttcaaaattttagctttttaagctgaaatgacctgagtctaaagcggcttgcatataaaatccattcatcaggtggggaagtagactgacttatttccagggcatctcccctgatagtctagagcttgatcctaataacaatttcaggtagaagaagtattttgaaaaacatatttttctactagattataaaaaccctagataccaaaatatgagtgtctcagaaatgcttacatttctgattataatatttatgtagattgtccactgatggcttttgtcaatcaaccagagtagtggtttccaaattattactgtggagtccaaaactttgtgcaaagcacaaggagtagagaggaactacaggagaagggttcaggaccacacactaa

SEQ ID NO: 1445 - DNA, 3817 bp, Homo sapiens
ggctcttcataaaaacagtttataaaatgaaagctgaaatagctaatgaaagtttgaaatgttatttaacatcaatatgaaaaaatgctaattaaaatgagataccatttttactaaatattttataattatttattaattaaaataataatttattaattataaatattaaaatattttattatatattattaatggaagtaaattgacaaagctttttggaaaaggacctggtaacatatatcaagagtcttaattgaaattatgcccactaattttattttataaaatctattcttaaaatcggtctaaaatactaaaaacaaaaatgctgcaataaaaactgctatttattagccatccatttggttaagtcctctatcacatgtttacaagggaagtgttaaaagaaaaataacagatattgtcattctcatttttaaagaatttttcagagagaagttggggggttatccaggataccgtaactagtaagttttggagctcagattcaatgtctgagttgcttgtctaaccgaaccatcataccaatggcattttttaatacatgaaaatgttcatattatttacaatgaggaaaaactgaagataacttaaatatctactgtaaatcaaaaatagaattctaagtcccccaaccatctgaatgtacctcctctttgccaagggtattccaaagttaacctgaaacactagtcctgcccatgaagggaagtggaagttgaacatggctcattatgattaacatcaacacagatcttaagactgatagaacagactcttaaaatctgataagtaacacttacaatctattctctctgcagcctgctacctgacagctttatctgcatgacaaaacctttgtctccagaaccgcttattataacctacacattcctttctgttgattccaggtcttcagataataactcaaccaactgccaatcagaaaacccctgcatccagttctcccgtctttctggacaaaaccaatatacatctcacatatattgatgtcttatgactccctaaaatgtataaaataaagctgtagcccgaccaccttgggcgcatgtcaggacctcctgaggctgtgtcatggacctgtttcagatactttttggtttacactaccaacagaaacatgactttgaaaaatatagattattcatacgattattttatttttctagacccaaactggttccaaaattatttgctatagctctacatggactattatgcatctattaaaaattggatttatgaaaatttatgtgaacatgggtaatgatcatgttataaagtccattgaaaagcacaaacctgtaaatgtaatgagttaatatttaatcagattaaatattaacaaatcatattaaatactaacaaatatttaatatttatatttaatactaacaaatatttaatatttatatttaatactaacaaatatttaatatttatatttaataaatataatatgatttacagctttataaaaaatataaatagcaatcagttaggaaacaaattatcttgagtagaggtaacagctcacttctagctgagttgctctaattctcccccaggaatccattactatctcacctcctttctgtctcgtctcttctctcccttacctccctcacatacgcagaaactgaaatttaaactccaaattttaactataatctgctttcttttttcttaatagattgctccagcgtgtatgtaatgagagatctttgaactagtttgtatattttggtcattgtgattataagagagtaagtgaaacagccttcatttgtatttattttctacttcattctcacctcattacttattttccctcccatatataattctctttaaaaagtacatatgtggagagtggacgttggaaagagagaatatgatctagaaagtataaaccaaaaatacaattctaagccccccaaccaacagaatggactcccctctcagccaaggggatcccaaaaaaaaccctgaaagactggttcaggccatgacaggaagagaggggtgagacatgcctcattataccctccttcctttggagttcaggcatagctgaccagcattaacatgaaaacagagatcttaagactgacaaagcggactctttgtagcaataagatactaagttccaacatgactggtacattacattacagatagcgggccctggggaacatcaaagtattttaccctccaaaatatatttgacatattttgaaattgccttccaaagctgtctcttgtgggggacatttacattctgtagaaaatctccttcccttatttggtcttttccagaaagtatgacaccttttaaggtcctataagataggggtgcccaacccccagggtctggtctgtggccagttaggaactgggccacacagcaggaggtgagcagcaggcaagcaggcattaccacctgagttccacctcctgtctgatcagcgacggcattagattctcataggagcatgaaccctattgtgaactccacatgccagggatctaggttgcacactccttatgagaatctaattcttgatgatctgaggtagaacagtttcatcccaaaaccatccccgcattgtccatggaaaaattgtctatgaaactggtccctgatgacagcaaattggaaattgctgctataagacattcacatctattatttctgaggcctgctacccggaagacttcatctacatgacaagaaccttggcttccacaatcctctaccacccttaccttaactcaggctgactttaaattttcaagcagagcttaactctttcaaccaattgctagtaaggaaatctttgaatccacctatgaactagaagtccccattttgagatgtccaacccttccaagctgaaccaatgtatatcttacatgtattgattttatgtctttgcctgtaacttctgtctccctaaaatgtataaaaccaaactgtaaaccaaccaccttggacacatattctcaggacctcctgaggctgtatcattggctatggtcctcaaccttggcaaaataaacctctacattgattaagacctgtctcagatactttttggtttacaaaagaagtgcctgaaaatattagtagttaagtcaaagtgttggaatatcagtgatatgtttttcaatttttttttcctaaaataatcatgcctcactctcattttcagtaaaaataacatagttaattaaaataattcatgatttaaacaaagtacatagtagtggaaacactgagttcattgaatacggatcatctttagcattaatcctaggttccaccacaaactagctatgtggggttggtaaattacataaattccatgaacctcggattactcacctgaaaattaagtatcatacttttaccttgcagggttgattaaaaggctgtaaataaaccaaagtgtgaagcactaaaatatgggacagagtaggtgctcaacaaatgagagctgaaattatattccttgtcataaatgttttactttttaatcatccttttcacaacctctagagagcaagaggcagctgtggctggcattattccactcagcaggaaatccatttaaatacctttaactcttaaaattttccagccctacctgtctgcctgcactaatgatccccagcagtgggagacctgcctttgatttctcctgtgaggctctgaaccccagtgcagtgactggttatgtttctcactttccacccttctcttacataa

SEQ ID NO: 1446 - DNA, 2165 bp, Homo sapiens
aaaactcaagcaggatgtggggtcaaaaaatgtttttattcgttggttgttgtattttatttgtctgtttgtttttaagatgggaaaaactagagcacatttgctatctgatggaaacatcagacacagagttgtagaagcatcaaagaaagaaatctcagaagagaaatttcttgagaaggcaaagggaatgggatccaaaacagaggaggaatggccacgggtgttttctctgctgaattgctgtcctaaaaggaaataacggatatgggttgaggcatatttattaatttggtgatggaagatgaagaagtacccttttgatgatgtctattccctcattgtaacgtgaatcaaggttatgagctgaaagttgagaggtggtgcagcgtggtgtgaaagcccaggagattgaagagcatggtaaaggcagaaaatcatttccaggaagaatggaagtctttcacttggcaacctatctgtcttattttctaacacaatattcagtcctcaaatcatcctaaaatatttaacataacttaatatgccatgtgtctgctcaagttccatgagtttaatcttgctttttcctctgcctagtgtgctaaccccagtcccaccttatttaccctgcaaacttttactcatccttgagctcttgcctcaggtaggggctcttgtataaaggcttttctattccatcagaaagagttagctccttaccctttctcctgcagtaatccacatcttccttatggggctcccataagggatcttcctgaggtcatgaaacctgtctcttcacctttattctcagacatagcacagaatattgtacaaaatgaagagatgcttataattgcttttggaccagctatagacatttagtagaatataaactatactaaccattgtgaataaagcataccactccaaaaatatgatagaaatctaaaatttaattaaatgtttaaaatagcattcaaaatagcaaaacaggatagaaatcagcccatatttactaaggaaggaggggtgtcttctggcacacaaacagttccaagcctgaaacactgtaaataactaattaaatttttttctgttgtaataaaaataaaatgccttaagcagtctaacctgcttttcccaactcatttagctccttcctcactgtgcaaatgccctttacaaaacagacatcagctttgcagaagatatttttgaacaattgaaatatgaagaaaaaactttgttaaggcatgccatctgttttggtttttttggagcccagtgattttatctttcctgagattcaaaccacctcaccctttgtagcaattcattaaaacttcactgctgaaggaaggtgaacaggggaatcacaaccataggatatgaaaaatagctgcttctgctctattttctatactcaaacctcccaagtaatagagagtgtttctaccactttgaaaaattctccttggctctatagtgtctatgggcaggaaaatttggaactaagttccagtttagcaactactcaattcctaaccaatctacattgatacaattatgtcttctgtaccattgcacaactacaactaaaattactactagttggatagtaaagtatttcaatatttctcaaaatcaaattgaaatccagcgttccaaagttgccaccactgcatgcacatttgcacattattaggaagcaatatataatttctggagcagttgtgtgaagctctcaaatgtttttggctaaaggcaaaattttagaacaccgtcttttatccctaattaaattacaaaattaaatgtcacctcaaaatctgatgaagccccctttccatggaaactctgaaataaaactagggtacaacacaaaaagcactggtcacaaatgtgagagcctccgacttcagttcaccattctgccactaactagctgtgcaacatagagtgtctttgagtctcagtttcctcacaggtgaaattaaggtatgggacctcttgatttctaagatcaatttcagccctatattttgaagaaatcaaaaggctacctgaatagcatttatgtctcattgtgaaacctgcataccttactattacccagtgctgtggaacccagtagatcttcaagaaatgttgaataagaa

SEQ ID NO: 1447 - DNA, 1680 bp, Homo sapiens
catttactttagaaaacttgtaaattctttatttgcccctttgtattaatataaatcttctcccagtctcttgccagttttacaagccatgaatatctttctcaagggccctggagccatatatccctttgacatttaatcaagaaagacagggccctgttgctgtctctgtgggagggtaggagcctaactttgataaacaatgattagcaaatacagatggcccagtcacattcaccaatctccctgctaaagtccttcagtactttctcactcgctccttccagtgtttaaaaattctcctgttctttatgtcaccagagttgggttcaatttctctcctctatggcaatagtcttcacttatattgcaacggtcttaaataaagtcttccttgccatttttaacaagtatccagtgcaatttttctttatagggactggttgtagatcaactgcttggacagctcaaaacatcataaaatctaaatcaaatttgctcgagtcagacaactgtaatttcagaagctcctgagagcttcctcccatctaactatctaaaaataatccctcaccagctcacaagggaaattaagtttttctaaaaaggaaaaagcctctcctacaatcagagataaaaggctggttgaggtaaagcttcagtgtgaaggcatctcagtgacagcataatcagtcaatcagcaggtataaatgggtcattgtaagatcccttcctatttggactggggagcaggaagcctgagaaggatagaagagccaggagagggaatgtggaggagaataaaaggcaggagaatgagggtatagacaaatttcacaggatttaccactttgcctaggttctgcctcatctacctccaactgggctaagattaaaagaagtggaatctgaggtatgtttgacatgcagctgcaaacacaggcagcacacttggcttgattagtgaagatgtttgttttattaaacatattttacttcttgtaaagcagcttagactttagcatatcaccgtacttgaaatctgacattgcttttccattttcctttttataatatgcattccattttcctttctataatgtgcatcaaattagtgtgtgcatgtgtgtttgtgtgtgtatgtgtgtgtaccatggcctcaggcaaagcaaaagactaacaatccctcatgaaaaacaaagcccacagtgataagaatgttagaaatacacgataaaaatatgtcttaaagtttttaatgaatcttacagaaaaaatattataatgcaattataaactggtaccaaaaaatcaagagattttactaaataacacataaccaacaaaataactaagccaaaataacagcaattacaattaagaatcaaaaagcagtaatttttacttttgtttagggatggttgccgggggaaaaagtaaaaattgaaatgtatgagatttcatgtcattcaccaatgaataaaattcacaaaactcttttacatgtttcaattttttttcctgtgacttctgatctcagagtctcccttagaaaacagtgggatttgagactaggaggaacggtggaatacatgcctactaaagatgtatatatttccatgaaactatttgatcccgaaggtataaaatataaacgaaattctaatgtccctcaaccat

SEQ ID NO: 1448 - DNA, 1475 bp, Homo sapiens
agaaaaataaagcagaaatgaaatttgaaaattactattaaaattgtgctttgatttgaaaagtcttgagtgtttagcagttttaagtccagctatttgtctttgtgcttaatagatgagaaaatagtgccttccttcaatttatcttaaatttagtgctgatcaactttgagaagcatccttgtgttcctagattataagaaatggcatggagtcatggttaacctgaaatttactgactgtatagtttaacataaatataaaggcagaaaaacatctaacaactagcaagaagtacatgtgaagaggtcatacctcattatacctctctcaaacagctgttacaaaactctctcaatcagtctattagttacagagagaacagctgtaaattcacaagagtaaatcttggtaagtatttaccacacagatgtcagactagctacactggaagagctgatttcactgagcaattagcctatttagtccaattggttgtagaatggttaacagagtttacgtagcatcacacaccaatagcatcactagtagcctttaaaagtgaggctaatgaatagtttaccacagtaacaatgctgagcatgccctacctcacagtgccaaaagaaaaagaaaaatcatccatcagctcactgccagctaccagtaacagcatctgtgaaggaagacttctgctcctttggagaaaaaaaatccagaaaaagtaaaaatgtaagcattctctagggagctttgcactaatgagccagtgaaattaagccccaaacagtcccgggatactgcccatgagctgcaatggaagttggatggatttatagctgctgagtgaggaaatggtttggaagaattacacagcaaattggcctagatcagctgggcacaaaagtctgaaaaaaaaaatataaaaccacagatggagtcctccatgtagaaactctaagacctggccaattttcagccatctgaattcagcctccttggtttatagactcattttattcaatcagtgcttcggcactggtgagaacgtttctctgaattgttgatctcatcttccacaaagggaagagaccctttccatggccatggggacagacagaactttattgctaatgctgcagttaaaactaggcacaagctagacgctggttccttagatttgccatgcaagagtttgctgtcagtctatattagactttctcctgtatgaaatttttgtctttaaatttttgaaattcaagcacagtaagaaatacattttatatcatatacagtgtctactcatatagaaatgattttcaaaatatttaataaccactgtgtaatgggcatgaatctattagaatagggcattaaccaaaaagaacaaggtatcaaccacatacgactatataaccaccatatagatgctgattggctaaattataatgaaacagaagttttagtaccattca

SEQ ID NO: 1449 - DNA, 2162 bp, Homo sapiens
tactggtcccttttaacattaccatttcccattaccataaagccagcatcccatattaagatgtggaaaccattatcaagggaagcaaaggggtaactgctggttctcttatttggaggtcttatctgcgtttggactcttaatctttaagcacagcccaactcccctgctggatctgggattcctgtcttggtgccagagatgttgcttagattgtgaggtactctttcaaaagccaagcatccacacatcactgataataaaaacactgaagtcacataagtactatagagaaagcaggaaaggtgaaggacctttgctttaactatacctgagtcaaaaggaaactgtttaaaaaatctgagatacacagacacataagatgtcacaacaggatcctattcataaacaagaaaatgcagaacatttgttttttaaaaagcagaggaataaatgaaccagaccaaggtctggtttcttaaaaaaggctttactaaattgggtgtccaggattataaatcccaattactatttgagtctccccttttctaagtatttccagaataagataaatgaccacattttgccttaaaactatgttaatgaaaaaacttctaaagcatacaatgcaatttccaaaattttaataatgataactcagtgtcacaaatgaagccaaatctggtgggtaagccagtgttgaaacataggcacaaatggcttagcttgtcactctcgtgcagtttgcaaacccttccccaagctgccaaactgtactgattgccaggcctctgtaatgtcacacaatttctcttaggggctgttgagcagcaggtacacatacctgtgcatgtcctcatggggcacatgcctgaaatcacacagctccacaccccaagttgcaaaactgttttatggacattttgcatatctctctctctctttgattccccatcagaatgtctcctgtttaacacccccttgctatttctaatctctgtagtcagctgttgcagctgtgtctaattccacaattctgcttctgtttcttcattgattattcaaaaagaatttattaagaattatgtcccaagcactgtgtcaggcaaaaactgaaccaaaaagacatgatctctaattgcaaggagcttaaaatgcagagtagacagatgttaaacaaacaaatatagcattagaacttgcagtaatataatactttgagggggaaggatagaaaggagcttatttggactctggttcctgaaggcatttctgaggaggtaataattaaactaaggcctaacagataaataggaaaaagccagagaaagagtgaagagaagacactgaaggcataaggtgcaacacaggcaaaggcctgaaaccaatgagagcttggcacatgtggggaatggaaataggttggtaaacgggaagagtgaaactggcatgcaatcaagtagcaaaagaagtaggagtcagatcatggcttgtaggtcatgttaaatatttttaacacaagggttggctagtaaacagtattgacatgatctgcttgattatattttaaatggctgtcttgtctgtcctataggacagaactaagaagaaggcaagagtggaagttagaaagtcaattacagggacattgcagtaatgcacgtggactccatctcttctcagtgagtttattctgtctcctccagtcacttatgacccactctgatttttcatggaaaagcttgacttagaggcactggtatccctcagtagttttctcttttcttccatgtggtaaatcaaacaatcagcatgagaaaagttccagcttttctcagctgtgttcaagattcccagaggctgctttgtcatgaaagtttaaagatgtcttaagcttgtgaagctgaaccccggaaaactaaagtctacattccactatattaaaaagagatagtttcatggattctatgtgacaatatatataactttaatatatacttatcagcaagaatttcccattttggaagtgaaaacacatctgtcaaaatttgacttcagtgataaatggtgttgccttaacattttatcacccgggtccttaacttgacatctataaacactaaggaaagaccattaatatcctgaaagagtatgcaaacact

SEQ ID NO: 1450 - DNA, 1750 bp, Homo sapiens
gcagctacagtgttttgtttgttttgttttgttttaactttaatagctgtatggcagattctcgaataccgaccttcccgattatggcagaggaggtaactcctctgggaggtcagtttcatggtgttcagggaatcactcctggagctcagcttataacccactctttcagcccttccagtgattttataatgatctaacaccctgtattaaatctgttttaaatacttcagatggtttctctttccagcattgaaccctgcctgataaacacggtaaggacagacattcaacaatggcctcagtagccagtaattagcagaggcagagataaacagttagtttagggataagaaattaagtctttggggaggcaggtgtgccagagtctccatcgcaagaaaagaatgcactatcctagttagcagggaaccagaacaacagcttcagaacaggctgtgctgcaacgcaacctgttggttgagttggcaaacattgatcttgggaaatggctcccagacttccattctggttatcctcctctatatgaattttagttattgagtgtctttaaaatgtggcaacaagatgggaacatagtacttttattttttggttggaggacagggttttgctctgtcacccaggctagagtgcagtagtgcgatcatggctcactacaaccttgacttcccaggctcaatgcaatcctcccacttcagcctcccaagtagctgggcacaagggttgtgtcaccacacccagctaattattttgttaatttttaaaaattgtttatagagacagggtttcaccatgttgcctaggctggtcttgaactcctgggctcaagcaatcctcctgcctcagcctcccaaaatgcacttgggattacaagtgtgagccaccctgcctggcctcaacttttgtataaccagcaaagtttactccaaacatacctctatcactgcagtctaggattgcattagcttttttggaagctgtgtcataacattggatcacattctgtttccagttaatgaaaattcccgcatcttcacttagcaactgatgttaattcaaatctacttacccttgcacttaggcagttgatgttttgaaattatggaaggactgaccaaaaaactatctcctttcatagaattcaattatttttgttcaaagaaatttgcatcaatgcctttaattgctcagttttgctactatggcaacattgttagttgttactattttttcagccattacattttctcatcagcttttccttcctatcttccaactggcatgtaacacgaaagtttgttttgttgttgttgttgttcttattttttagccgaggttctctttctttgagatggagtttcgctcttgttgcccaggctggagtgcaatggtgcgatctctgctcactgcaacctctgcttcccgggttcaagcgattctcctgcctcagcctgccaagtagctgggactacaggcatgcgccaccacgcctggctaattttttatttttggtagagatgggatttcatcatgttggtcaggctggtcttgaactcctgacctcatgtgatccacccacctcggcctcccaaagtgctgggtttacaggcgtgagtcaccatgcctggccaggttattttgatagatcatttaaatatttctcctaatataactaattgtagaaagaaaagttaaataggattcagaaggcctgagtactatccca

SEQ ID NO: 1451 - DNA, 1795 bp, Homo sapiens
tcacttgtcctttgcataacagtgtgggttaggcttctaggtaatatgtgaatagcaacatacaattacaaagcacttttccttgcattttcttccattcttacactttacaactctgtaaaactatagatcaggtaatctttacgtccacatgagggacagggactttcccaagatcatacaactcaccaggttgcatctttttattttgcttagtggtttctttaaatccacttgtatttagcacactttctatgtgcattgaaattacatatcaaattattccttccttaataacatctaatttactaatgtgttgttagaagtatgtttaaaggacattaatctacaaagcctttctagtgtttctattaaatttgtatgccacatgcgttggcatatagtatactttctttgtgcaaatgtttttcaagagctactccccaaatgactttgaaaaggtgtgaaaaatagtccagatttgggaaaccacagttctttgatgacattaaaccggtttgatcatattacacttgtgatacctgagaatttagatttaagtttctccttctatcttattagagctgacagattttggaaaattacattaggaagttttattaattgttaggaaaatgtattgtagaaacccaggttatatttaaatttgataagctacacaaagaaaattcatcaacagtccacacaggtagggccatgagtttttgccagcccatcagccaccagataacccacaaggcttggctccctggtctcttagtggtgccagtgacacatgtgagtacacgcatgtatgtgagccaccttgctctcctgtagtgaagcaggatgttctattggaccaagttcacatttggtatttgttcaccatggtggaaatgaatgggaaccggggcctgtcacagaggtgagactgctagccaattcaaggcatatccacaccatttttgaggaaatattaaataaaatacatatgtgaccatttaagtgcctaatttacagcacttgatttgtctgacacacaatgagggtaagaatagtgttctatataaatggctccttcgtttttccactttgataaacattcttaaaaagagcttcatttacaaacattacactttcctaacatttgtgtttttgcaaatgcttagagttgtagagtactcctcagaatgtatacattcagttccaagatgaggctgcctcttaagaatgtcaccaaaccacatcaataattctgcctgcttttcaaattttgctgctggtaattaatttctacttaatatttttcattaaaattagatgttctcctttaaactcttaccagctgcttgattagacaatattgttaggtacgatgtagcagttttacctcatactatctcagtaagtaaggcctccatcttttaacagttgctggtattggcaaattataatgtttgtaaatgacagataagtaacaccttgtatgtacatgttattttctaattaacattggaaaatgatctggggttatacttttaaaacaatgtgaactttgtaattaatgtgttaatctgctttgctctgtaaaatatttttaggtaattatgaattaatgtagcataccatgttgttttgggggaaaactacaaaatgaggataaataaagatgtacccagacatttccgaagcacttaccattttatgaatttcttccatatccatcatcaggttctaaattagtggtttgactaaatatatgatactaagagtatatgtggatatagcaatg

SEQ ID NO: 1452 - DNA, 2381 bp, Homo sapiens
gctatcacgccaatgcactccagcctgggtgacagagcaagactccatctcaaataataataataataataattttaaaaaagtaaatgtccttagaccaccagtaggctaaaattttctttccttacttcatcttgagaatgtatgtcctcttttaagaacgtggttacgtggtttccaaaagtggtattttggcgtgagatgagaatagactttccagtgtccccacatttaaatgatttccttacaaaacgactgtaatggattttctttaaaaaagtcagatctgctactatattttaaatatgacttaataaaaatatgtattattttggcaacatcttttattttaggggtaagttatagcaatgctatttgagtacagagatgatattacaatataccttctgaccctttatataaatatttagagtaagggaaataagtatttttctacaaattcaatggaaatattctaaattcttacatcattgcaactattggtaactactagtgaagttgaatttagatggcacaaattgactgaattttcatgggtacatgatttttaagtttttactgcaaggtttggtagcctaggaacagcaataagagcacagtggggttgcttgagtggtgggttaacaatgctgggtaaatatgtctgttctccccacttatattttgcatgtctctttacctaattaaatttgtttagttacaatctcctagaaggataagaaaaaacttactaccttacttacctttctctccctcacagccttcccagaactttttcatgttcaggagctaatgtcctggtcttttcatctctggagaatgtataatcacatccttaacatctccttgcactcaccttaagcactgccctgctcttaggttcttggcctactctgcttttcttctctttccagggtgctgaagttctaaactcctgcagcttttctctctcttcactttcagaaccaagaggttctgaatggacttttacaggaaagcctggcctggaggagtggctcatgcctgtcatctcagcactttgggaggccaaagcagaggaccacttgagcacaagagtttcagaacagctcaggcaacataggaggactctgcctcaaaaaatagataaataaaagaaaggaaaacctgttacctacttctgtctgtcaccagctcctcctaacccatttagggatgcttctttgaggtaatacttttttgattcggcttccttttgccaaatggcttcctcaagtctccagattcacgcttttgtcgttttgaaaccagtgtctgatatgtacgataaagttaaatgggttttctaatcttgtgaattgcaggtgtaggaggtggagctttgccaagcaatcatgaccatctagaactgtgtcaggggaaaaaagagaattgcaacctgtggggtctaattgtgtgtatgctgaattttagaggttattaataaagagggaggaacaaataggcttaagtatactataatggttaagaaacatttaaaacaatataagcagacacacagcttaatgggttctatgaattaatattcccgtgatgaattagcaacatgaacaatggaaagattcattagagtttgtcctttcatctggtatgattaatatttatttgaagtaaaatgccacccgatttaaattatatagaaatatagactaagccaggctctctactggaatatgcaaacaattctgattcatgttcacctctgatgaaacagtgaactgtgaacaaaggcagagaatctaaagaaacttgtgttattaatactataggaagaatcctaactgatggacatttggttcatcttccctctttgaatgtaaccttgaatctattgtaagatcatgataggaatacatagactaagagtttgctttatgccctcagtttgctttctgtgttctattatatttgcttttcacatctaactggtaaagtaggcaagacaagtactattaatgttatctttcattttacagaggaggaagctgctcagtaaagatgagtaagctatctgggcacagtggctcatgcctgtaatcccatcactttggaaggccaagataggatgattccttgaggcaaggagttggggcaacatagtgagacctcatctctacaaaaacagaaaaaattagctgggtgtggtgatgtatgcctgtggtctcagctacttaggaggctgaggaggtaggatgaattgagctcacaggttccttgcaccatacactctagcttgggtgagaccttgtctcttaaaaaaaaaaaaaaaaaagatgggtaaactgtccatggccatgttgtcatggacagtcttgtgcttt

SEQ ID NO: 1453 - DNA, 1981 bp, Homo sapiens
attgttacggactgagggtttaatgacctgccctgatggagaatcacttgactctcttggttccagcctccatgttgcaggaagagagattgtgccccgttgttttccagaagtaagaagtgagcttcgcatattaaggagcatttcctagggattacgtggaaaggtagaaaagaaagatgccctttctctcactactgtaagtcacatatctctgagattttcagatagggggtacgagtttcccaggactactgtagcaaagtaccacagactgggaggtggaaatagtagacatttcttcttcaagttctggaggctagacatctgagatagtgtctgcagggttggtttcttctgagagctgtgggattagttctgtgtgtctccctttctcagcttctggtggtttgctggccatctctggcattccttgccttatactccaatctcagccttcatcttcacatagtattctctctgcatgtgtgtctgtgtccacatttcccctttttataaggacacctcaacatatctttttgaggggacacaatttaacctacaacagaggtcttgccgatgaatccctcagagttgcttactgtagttgtggtgttcttaccggcaaggaacatcaagtttcatggcaaagctttcaccatcacatgtgccagcaggtgttgtttctttgtccaggatcctaatcccagtcaatttctctggccttttgcaagactacatcagattacatagtataataaaaaaaaagtaaagagatataaactagtttaatgtgtgtttgtaggtatgaagcagagaggtttagaatttaagctctagaatctaacctggtttcaaatcatggctttcctatccctgtgacctgggcaaggcacgtacactctgtcaactgaaggtaataatagtgtctctctcacagaggattgcttgcagaataaatgagatattactcttaaaaccttaactgtagtgcctggcctagagtgtgagcatatgaaatgacagccaacaagaaggcaaacaaaaaggtcctgctgcctcttgcagatattgggaaacaggcctattccaggcctgagggaaacatctggctcgttaccttgcagtgtggctcacctctgtctgctacaagtcctacgctgtcatgattcctgctctattcagcttgtgtgtctggacagttgttctcagcactcagcacccagctggacaccagactgctttctcctctttcaagctgttgcatttattgtgttttcagagcaggactcatatttttctcattaaagcacattattggaggaaagggagaaaaaggtaaatgtcagaatttgcttaagctcctgaagtagtaaatgctatttaacatcctcccaccaccaaaatttgagttttagtgtttccacacttaagagcttggaaatgtatgacttactgtcattgatgagataatacaaatgacacctccacactttttttgcagagagtagggagacaacagggtttgtccttgtcgatttttaactggtagagtcaaatcctatagaaacacatttttcctgttagcatttatttggaaatatgaaatgtatttgtgtgtggcttagagctgtccctgttgattgtacatcattattaaacaacaaagagggggttaaatcagaaacatacattggcatgcttagtaaacatgttaatggaagttcaggatactagcctatagttttgtaacttttatgtatttgtttctcaacagtatttatttataaaccttttaaaaagaaggcaagggttttgacaacttccaaaatacttggccatcatttttaaggatctcctatattcaaacttatatgataggccccatgggaggatttcaggcatggagtaaggatgagagaagcttctgtgtcctgaattggtgggttcttggtctcactgacttcaagaatgaagccgc

SEQ ID NO: 1454 - DNA, 2768 bp, Homo sapiens
atgtaccaggaatatagttaactacttccttattaattacagcctcccaataatattgaagtagatattatttattatagctgttttccatatgaagaagtgaaattcagactgatgaaatgatttgcacaaggtgacactgccaataattgatatagtgagattcaaacctaggtgacatacttttgacccaacaaaataagttttcaacaacttgagtgtctcagtgatagaatatattatctctggaagcagtgagcttatcatcatgggaagtatgttagcagatgttagttgatgttggttgatcatatatcagagacatgaaaaatattctactactaatgggcgatttcacttgctcatctccctaggccccttctggagggttagatattttgttgaattgaaaactgtaccatttttaaaccattgatacgtcataagcaaatattagaccacagaataatactcaactattttacacttaagggaaaccaaatatcacaatgaatattatctctaattttagaatactagagaatctcagcggtatttgaaagatcaaaatttatattatgcatgttatttttgcttttaaacactagttagaatgtatggtgctaaatacattttagcgtctgtggtgctaagaacacaatcgtttgattaaacaagatctcttgataaagattagttagcacatgctagcctaacaattactgaaattcacatttttacatgggtatcctattattaagtgattccttagatttaatctatctgaaaaaagtcagtaaaatgttatataaaataataataaaaataaatcctctcttgatttagataaaatagcatgcttgtgtgctaatgtattctactacctaccttccccagttgcttctattaaaaatagtactgtaaaaagaaataaaaatcaaaaatataatatgcctgttgcaaagcgtttcagagaagcttttatgtgaaatttaacagttcatggaacaaagaatatgactggaggcaaggaaaatttctcctctgaaaataagtgaaacctaggtcgtcattagagtttgtgcattcacttttgggacataggatatgttcagggctatgactcatttacatacatgactatgtggcctgtgttttgggagggctgtggggtgttagctgaagccttccatgctggtagttatgctttgctaagagaaggctggttctctacttacaccccctcagatggctctctttagtgcatgtctgtatgatttgacctaacagaaagaagaaatggactagcttctgttattctatgtcagcagcatattttattgaaaggagtatggacttcaggaaaagaaaaatcagggtttgaagcagctgagaagtcaacaagctacttattcttctgagctcttcttcatctataaaatgggcataataatacttcactgagtgagttgttttgagaattgaatacaaaaaatgttgacagtagtaaactgcacatcatctgatacacagttaagaatggagtacattttagcatccttttttttagttctgtaataaggagattgtaaatacatttaaaaaaaaatgtttccctagagtttggtgggtgatattgccacttaggaggatagctatcagctgcactggtgacaaagtacctcctgatgcagacccagagctacataagcaaacatgaggggcttggaagcaacccagacatcaagcaggagcagtttccagggctgtgaagatgtttgctctcctctacttagaaagaggctcttttaggagaaagggacatatttaggagaaagagctctgcctgttcttgcagacccagggaaagaggagcttggatcaggaagccagagagcatttactctgccttagtgagttcctaaggtcctagaaactctctatgggtgggtctctgctgcggtgagggactctgaactgtgacctgcccctcagatcccaggaagaagagaagcaaaagcttagaaagcaaggctgtaggataagtgttagccactgatttcagagctatgtattttccagcaaattgtctaagaactatgctttatctatccaatatagacaatgtactctataataaaattccttaggaattaattttaatagctttcatttataattaaaatctagatggcatttatatattgacaaatgaatacaatttaaccttaagtataagaagaaaatgccagccttaaaaatacattttaactacttaactatttttatacgaatgcacttgagattaatctaatatagtccatatatcttgcagtcagttcaatgtaacaagattattaaaactggtttagaaataggagggtgtttatgagattatctgtcacccttgtattgtgaagcctgagcgcttgattactctgcatgtttgctcttgtgtaatgacaagcacgtcccgtggagccaattactgcctccactttacttaagtgatcctccatcccatcaagaagatattcaacctgattcttagaaaagtgtgagtatttgaagtagttccagtgaaggtggtaaatttcctaacttgaaagcactttcttatgattgcaatgacaatggttaaagaaataaaacttcagaaaagattccacatgaaagcaacttagaatatgagtaattataccttaactacaatcctcagtgatcaaaagataagcaaggtttcccaagcatctttctgtggagcatgc

SEQ ID NO: 1455 - DNA, 2517 bp, Homo sapiens
ctttgggaaggtggtgatggacacaggacacgtggccacacaatggggacacacgactgacctcagtcacttcggtaaactgcccttgctttccggaggcggcaggaacgtttcaggagctccaaggctctaggcgcctgcattcctcgccccagccggtagtctcctagccctgttgaacgcaagagcatccaagggcgcgcaagtccccaagagctctcagaggttcctgaccctgagcgttaaagcccttcctcgcggatgagacccttggtgcgttccacccgcttgggggctgagactcgccaggacgcactcagaatgaactttccgcgcaggtcagatataggcacccaggggttttgtgacgtcacaatgccgtctgacccggtgaaaggcaaaggaagggtcaaaaacggatagtgtgtgtgttgtggctgaagtgggggcatgtgagaagagggaagtccgaggaatgggggaagggatttggggacatgaatttgagaaggagcaatcaagtttgtgcgtggggggggaagcaggattttttcttcttccctcctatatgcaaactgtcacttcgggttagcgtgagcccttatctggctcattagcatgagctgtggctaacacgcttaaaccctctaattatttattatgccgtcacggggcggattgcaaccccaccccggggcgcactttcgggaacctgcagagctgggcaccgcacgggggccggagcacagagcctggccccgctgcgcgctaccagggagactccttacggctcaggagtcccacagggtactgttctgagggtcaacgaagcagagttgttgggggtctatctggaatggcttctcaccaacattcatccccagggtagtagtactgaactcgcctggtgaatctacatagcaccctaacttctccattaacaactccaaagacggaagttggagccaagaggaacagactttgcaaaaataaaaacagaagccaaacctggtgcaaagggttgggaattgggctgagtagcatgttgggtacaccttccagaagaaccctggggagaacctaaagtttgctggagccctcttccccacccccgagttccaagaggatccacaaagtgggggtgggagatttgatgggctgaaatccggtcactcacgtccacggttctattcagaaaacagtttcaaaataagttaacctctgtagggcatttttccccctcccctttaaattgtccccccttccccctccttcttctcatttgagtctgttttatgttcccctgcgttgtgccaactattttatctttattccttctctttctctcttgccattcattgctttttttgtgtgtgtggcttctccggctgatgtgcggctcgttaccacccactgcacacttgctcctgtagctgaggtgtttctatacaaactccagcgtccagttgtcatattaattattacactgagtaatgactgaaatggtcaaaataaggggagactcaagagcgctttttcttgcggctcaaagattcagcaaagaagccgtacaacaaagcactaattggtccccagaaacactctgacaaggcatggaagataggtttcatagagcccttcgattgtgaaggggggagagctctgaatggactccacgcttcttttctaaactctcttgctgagcaaaaaatggacctctgtttgaatactgccctgatccttgaatactacacccagcagagaaaaaaatgcaccatttattgtaagttttttttttcttctccagctattcaggggttctctgtgaagaatcagctggttttgtttaccatgaaagacctttactttattttcattcttggaggaggtggggaggaggagggaaggaaagccatgtgcctagacagagaggagctggcctactgtaacaaaatagagtgtaacaaatcctacaaaagtttagaatgtattgattctttggagagctatatagattaacgactttctttatgctcatccaaggaaggtatttaatcataatgtaaatggggctttagaaaaaaataaagacttagcgttacttctccttatttggagaacttcaaaaggacttgtgagggtggctgcaaattacctcctcaccccaccccacattccctccttatcccaaaagccacaataaaatatagtttgtgctttttttgttttgttttttcaaacttttttctttttaaagcatattgaaaaagtgaatagatttgttagaaggctgaattccttaatgcaggtgcaagcctggctgctgtgaccaggaagctgagccaagccaaatacatggtttgtgctattctgccccctgagcaggccctccaaggctggtgcagagtcaatgcaggctgggcagcaatcctttctgaaattaccttgggtagggtattcttagaggcagtagattgtgcagtaaagtccttttcattttccctgggtaggacagtg

SEQ ID NO: 1456 - DNA, 2399 bp, Homo sapiens
ggttccacttaattccatgaatatttaatgaggtcttttacacttgctagaagcaattcaaataactcccggcattgtgtaacctctgggaaatatttttcatatagcacctcagcaattgtcctttccttgtaagttgttctcttctggccttgtaggattttactctatgcatgcacttactggcattcattcaaagacacaaaaggacctctatccaaatttctgatgctctttcttagtgtagctctcttcacttgcgtaccctgctctgcacctaattctagccacctaggcatttcagaatttcagtctaactcctcgactcagagagactgtatggaatttccttctgtgaaccacagtctggtaattacctcagacagaaagtcttggcaatgtggaccttacctcctttgttcccttttctaaggaatcatagttcatttctgcctgttgttcagtgtctgaaaattgttattgtctatattttgtccatttttctagtattttattgtgggaagttaattctggactgtcttatcctgtcataggtggatgcagaaaaatgcctgttttaatacctatagttaagccaacatcttatggttatttagttaatcccttaacactaagagtttagtgttatttctctagttttaaatattatgtttcataatgctttttctaattatttctatgtaaaacattatacctagtgccaatgagaacattattattaaaaatgatttttttcctttagaggatattttcttaagatttagagttaccaaaacaaaggatatgaacaactttatagttctcattgcagtatttcctgattgtctccagaaagataagactcatttacagtgcctctaggagtatgaatacatatttctcctgattgctagcattggactttatcactctaatttattttcattagttgaacccgtgagtaatggtgcctagaagatggttcaatttgttattttttctcatagtgctaggagtgcattttctcaatagataattaaatgtctgatttttcttgtatataaactatctgttcatcaatcttgatgatatagcaagtggaattatggtatttatattataggacctcattacatttggtagaattgtacgctattatctgttgtgtttttcacatagcttaatcccctcttttagtttacaagtaactttcatttttcagtcttctttaagcaacagattgttagattttgttcttaattctgttactggttcctcttcctcctccgcctcctcctcttcttctcatctcttcttcttcttcttcttttttttttttttttttttttttgagacagagtcttgctctattgcctagactgggacaatcatggctcactgcggcttcagcctccctagctcaggcaatcctccagagtagctgggactacaggcatgtgccaccacacctggctaatttcttaatttttggtagagatggcattttaccatgttgcccagtctggtcttgaactcctgagctcaaatgatccacccatcttggcctcccaaagtgctgggattacaggcgtgagccaccactcctggcctggttcttctttatccagaggattttatctttttggcttaaatataagttgatatatttatgctttttactacttcctaagtctatttttaagggctgctatggcctgctttctctttttatttgcattgccactgtagtaaattttagcatcttgatttcccttcattctgcactcccaatctactggactctaaattccatgtctgtgttgtgaaaccatgtctgtgttgtaactgccatattctcagtatctagcacagtatctggcacattgatgtattcatttaaaaataattactgagaccctgccgtgaatgccatggagaccaggtatatgtgacttaaccccagtaatcagctcttttcaggaatctagttttatcttgtgcttctcatattttattgtctgttttatagttattaatgtttctttgttaactgtgccctctggggatgtcctagacaatttctctttcagaagggttttcatgtaattcaaatctgccttgcccctgatggaagttcttgcagctgtgggatgtggggttgacaaattatttcagtacctctgacatatctcatattagctcataaaaggtcaacctggcctaggttaaaggtcaagcaaaaggccaatcagaccttgaaaggtcaacctgaccagccctgcaaggatactgacaactccatttctcttagttttgtatgttttccccgaagccttccttttctgttctctatagtttaaggggtaaactccagatttgttttcttcttacatctctca

SEQ ID NO: 1457 - DNA, 2252 bp, Homo sapiens
ccctctccatttttaggaagatatttaaaattatgattatcatttctacagttttgggaaatagtcattaaatcttttgaccccctcccctccaaattataatagtctctctatattttttggtgtgttttttttccccacaagaaacattgttacctttttttcatttctacttctcctgaggccctaggcccattgtattaacccaccaaggttatgtttaaacagtaaggagccaatttggcaggacatgaagtggtattaggatgaatgatgtatccttgtggcctggaaaaaaatagatgtaacattatacatatttgcttaataaatgataaagcacatgaaccacagatacagtttaaagcaaatgggatcttgccactatctaattttgatcaaagcactttttgcataattacttagattagggattgccatttggttaattacaataaatatataagcaaagtgtaattaaaaggttgcagtgagggtaattttatttctgatcattttatgattttatacttttacaggacaaataaacttatgctttgcattttatgtacctaggtactctgatagttttgtttagggtttccaacatttgcaacctttttttttttcttttgggaagttgtgtgttagggagtcatattctcattaccctggttacaagcttctcagtaaccaccatgttaccttgcttctaagatgcacattttcctattaaaaaatggagcacattttacaatcatacacacacacagacacacacacacttcttggagtgtttctgacttctttgccccacccctaccattgcagttattcagttgatgatgccctttcaaatgagggccattttagaacagagggaatggtctgttgactttgttttaaatggtggcaccatgcatctcccttgggcctgctgggatgttaaatggtgagcccagcagggaggaggcccttgatggtgcccatagcttggtgcaatcaaggtgaagtggatggagagttcctgatgctgattaaaataagcactgaatgcacaacatgtggccatttgtaaactcatttctcatttcacacacgttactgtgctttgccttcctagctgcatttgttggcccagtatgtcctcatttactagatgctgaaacaaagtgatttagtgactgtcagacaaatactggcatagggatccgactccagtcatctgccttctgattccacactgttcttaccccatcaccgttctgccatccctgagatgtagcagggcagccttggccactctcttcttcctgtggattgtactaggtcacccctcatctttaaatgttgaggactcggccgggtgtagtggctcacatctgtaatcccagtacttggggaggccaaggcaggtggatcacttgaggtcaggagttcaagaccagcatggccaacatggagaaaccctgtctctactaaaaatacaaaaacagttagctgggtgttgtggcaggtgcctgtaattccagctactcaggaggctgaggcaggagaatcgcttgaacccaggaagcagaggttgtggtgagccaagattgtgctgccgcactccagcctaggcaacagagtgagactctgtgtcaaaaaaaaaaaaaaaaaaagttgaggactcatggtccacattataatcattgttttcttccctctgtaagacttgcagagtcaaaggctcatctctggttctcccttgccctgactccagcaaaacccaaacatactctttatccttttccacaaaaataaaaaaataaaagctaaaaagatattattttctttttagacgtaagctgaaaattctaagcccccccccaaccaattaaatggaccccttctcttggccaaggtaattcctaagttaacctgcaaaactaggtcaggccatgatgggaagtggggattggacatgcctcattataccctcttccctttgaaattcaggcacaactgaccagcatttaacattaaaacagaccttaagactgacaaagcagactctttgtagcagtaagataccaacatgacagcaggctctgaaagaagtcaggccaggtgtggtggctcatgtctgtaaccctaacactttgggaagctgaggtgattggattgcctctgctcaggagtttgagaccagcctcggcaacatggtgaaaccctgtctctattaaaaaatacaaaaataagccaggcgt

SEQ ID NO: 1458 - DNA, 1966 bp, Homo sapiens
gaagggtgcttttaaagcatcctctcgtacaccatttgattgttatgacataatactataattctaaatgtgtgggcaactgagctgaatcagtactgaccccaggacatcccattaaagtgtttttgctatgtgctaagttagcacattgtctcaaccatactgggaatcaaatagatatatctgtgtatattgggactaatcactgatattgctgtatttaagtcatttaacctttttttcacaaaatggtatgtgcttactggggatgagggggtacttttaaatctgtttcagggctccaactgagttctagttaataaagcctttaccatagtgatgaggataactgctcccagccacctctgctacccaaatcaagagcccctttgttatactcttcatgaaaccaataaacggcatgacaaatgtttccaaaataggagttattgtcaacaaacgctattacctccctaaacaatcagagttgtatgtaatttgtccaaggatgccaaggcaagcaaccttttcgttataaatatctactaggctacttttaagataagctaaaaaatatagtgcctgaaatttaactgagagtatcgaaatttttctcctttagactaaatatatttcaaagtgaataacatgccttattaaaagtagcaaacaccaaagcagcttacatttaaacaagttcaagattacctgtgaaaaataaaacaatcttaatgaagagacctcatgttgaataggttcacacttcccttattcaagcagtctttccacaaatatttactttttttctcttgtgtcagaaagtaagccttcaagattagcaaaaagtcttacttcccccacgtgctagcaaagtcaaaaataaaagtaatttttaaaaaagaaaatattttgcatatgacattatataaatatgaggaaaagactaacaacagatttatgaacactctaaccttccttttaccatcatatacatacaatctttttcaacacaaagccacttcatctttatctaatttttatcttttttttttttttttttaaatcaagccagttctgctgcatgattaactgtttactgcagggtattattctaccacaataccctggcaaccagctcatattcagttacactatcacagcacaaaaaaaagagagggagagagagaactaattgtatgatcatgtggatattgtagaagccctttagttcaatcctagatgggcctcaagaggataatgcttattctgttgaactcactgccaaatcccaatatgaaactgccaggatcaaaacaagacccaattatactaagagtgcattttatcaacgtcgggtttataacaaataggtatgtggccctgtacttgtgcaaaattgttcaaaaatatttacatagatggagcttaaagaaaattatggaacacttactggccataatgatattcaatgagaatctcttcaggtagcatccagacagcagctcagtcatgaaatgcttaaagcaacagaatccaatttcatgatgttctatacttaaaacagatttcggccaggagtggcggctcacgcctataatcccagcgctttgggaggcccaggagggcagatcacttgaggtcagaagtttgagaccagcctggccaacatggtgaaaccccatctctactaaaaatacaaaaactagccaggtgtggtggcacacacctttaatcccagctacttgggaggctgaggcaggggaactgctcgaactccggacgtggaggttgcagtgagcagagactgcaccaccatactccagcctgggcaacagagtgagactccatctcaaaaaaaaaaaaaaaaacaccacagatgcctacactatctgggttttttaagaggaaaaaaatatttacgtgttatttctaccattaaggttttttttttttaaccttaggccca

SEQ ID NO: 1459 - DNA, 6382 bp, Homo sapiens
atgtggctgaccgacaaggacacccacagaatctagcctagtccagaaatgggtttgccatgtccaatccatcccagaggctcacaggtggaaagcagcacataaatcaaaaacttctgggtcctcagacgccactcagacagcattctgttggccattcacaccagctgcatgcacttaccaggagtcagtgtgtgaggacagtgatgaaagaccagcagagtggtggctgatgtgtattaagtatcatcagcaaacgatgcagtcaattgtttggacagggatgtgtaaacaccagtaataccacccccaaaccagacgcctgtctagataaagagtttttcaaactatgttcagcctcattgagttcatttcgaggaccagtagtttaagatgaatgacaggatgaaaaaggacattatgcactgaaagtaacaccttctcatttagttgcctgtatgctcatctgtcctgttcctccgcagtgagcacaattcccagcacgcacagagcaggcacccacaagctgtcactgaatgaatgaattctagattcatcatagcactcccagcccctagcaccgtgactggctcagagtatccaatgtgggccaaaagaagaaagaacgtcactgtgaaaattaattttccatctacatcaaaatcacagtttgaattttcctcttttaacctgtgatgttattgctaaaatactcctggcattgtgttcattcatttggtgtttactgagcccttgttgtgtactgggctttgctgagattgtatttcctgtggttgaagcaagagcgctggcatcagagggatctcagaatcccagctctgctccttacttactgtatgtcttgaggtgggttacctcacctctctgggcctcagtttcctcatcgatcaaaggaaactaataatacttaaccctgtagttgaatacgaggattgaatgagataaaagagttggaaacaggccttggcatccagtgggaagtatagcacagtggttaggagcatgggggcttagagtaggactaacgggttagaatcctgatctgtcatttagtggctgtgtgaccttgggtgggtgcattaacctctctgagcttcagttttattatctgcaaaatggggccaacagctgctgcctttctgggttgtcaggagaaccacatgaaatcaggcatgtaaaggtgtaggcacctctctatgcctagtacatttcatggtaactttccatgagatcactggctattataaaaagttgttaagtgattaataaaatagtaaacagacacacatacacttgtacaaatatatataagtgatatatctatacacatatcacaactgtttatctgtccacccatccgtatactaatctaaaatgccactgatagccacccatgatctttgactaacatttttttcttcatctgcttaaggcgacagtccccgggtagctgactcacagaaagtctgattcacatgtctgaggaggtcacccagccagttggcaggaggcagcccagaatgagtcagggctgaccctgcatcccccaggttgctgtcccaggcagggcatttgctgtggctgctggagcagaggtggaggaagggtgggcagagcagccaattactccatgttgacatttcaatatttgagactgtgggcagagtccctcccctgggtacttagttcctgaacagccacctacactcatcacaggccagatcccagaaaataccctccccactgcagaccgcagagcaaatcaccgccaacaggctccaagactccctggactctcctgctcagggtaactgcaggaaagtctcaagcttcagatttccacgccttgtcttctttccctccttacaacctctttcccttcagcagctgctgaagtctttgcttctctcactcccgtatgacctcaagagcttctggagaaactaccgcaccagtttggcacagctactaaagtgaaatatacatacaaataaccctgatatggtttggctgtgtccccacccaaatctcaccttgaattgtaataatccccaagtgtcaagatcagggccaggtggagataattgaattatgggggcagtttcccccatactgttctcctggtattgaataagtctcatgagatctgatggttttataaaggggagttcccctgcacaagcgctcttgcttgccaccatgtaagacgtgcctttgtttcccctttgcctcccatcataattgtgaggcctctccagccatgtggaactgtgagtccataaaacctctttcctttataaattacccagtctccggtaggtctttattagcagcgtgaaaacggactaatacaaatccacaaccagcgattcttcctctaagtaagtacccaacagatatgaattctcatattcacccctacacatgcactagaatgttaaagcaacctatctgttgaaatcccaaactagaaccaacctgcaatggattgaatgtttgtgtccccaattccgtatgttgaaatcctaatcccaacgtgatggtattaggaggtgaggctttggaagataattaagtcatgagagcggagcctcatgaatgggattagtgctcctttaaaagggactccagctagttctcttgctgtttccttgccatatgaggatataaggagaagtcaaaagtctggaagacggccctccccagaatctgcccatgctagcactggatctttgacttttcagcctttggaactgtgagaaataaatttcttttttcttttttttttttttgagatagagtctcgctctgtcatccaggctggagtgcagtggcgcaatgttggctcactgcaacctctgactcctgggttcaagtgattctcctgcctcagcctcccaagtagctgggactacaggctcaatttctgttgtttctaagccactcagtctgcagtaccgtgtcacggtagtccaaactaagacgcaacccaaatgttcgtcaacagaaaagtggataaaatatgatatatacttataacaaaatatgttcatgctgtactatataaaaataaccaagctactgctaactgcaaaaagcatggataaagctcaccaacataatgttgagtgaaggaagcctgacacccaagactactccatttatataaagtgcataagcaaatgaaactgacctacatgctgaaagtcggcacagtgatggcccttgtgtgtgtgtgtgtgtggtgggcgggggtgctggaaggagcattattagggggctgggggaaggcagtgttctgtgttttgatttgggcgctggttacatggatacatacttagtggaaactcattgggctgttcttttatgatctggataattttgaaggtacgttatccttccaaaaaatgttttaaaaagtcagagcctgggcaacatggcaagaccccaattctacaaaggatacacaaaaaaactagctgtgtgtagtggcacatgcctgtagtcccagctatttgggaggctgaggagggaggatctcttgagtccaggaggcagaggctgcagtgcatggagattacaccaccacaatccagcctgggtgacacagagtgagaccctgtctcaaaaaaaaaaaaaaaaaaagtaagcagggaaagaattaacaattaatataattaatgtatggcgttgaaatctgtaaaaaatgtaaagcggcactgatacccaaggtatccttttctaaagtctttacccagtgaagagtatttgcagatgggcaatgtctacagaggaatttggggctccaggcctggctgtgcccacctggatgtttatcaggaacaaagctggagacaagttcaagatgaaagctgagctttaaagatgagcaggcctcaggcagatgtccaggatgactgaggctagggcggccccggcaagtcagtccaagtgtccacagcaactgctctgagcttggaattcctcatgactaataatggtggcctaaaagccactcgcagtgtgggatgtggggaaaggaagggagaagaggatgaaagtttactgagtatgtgcttaggacctatatcacctccatgattccttctagcaatgctgcaacccctatatatataatagcaaaccctattatatctattttatgggtgaggatatggacacctagaggaccagctcgtggatgcatagccttgatgggaacccattcccgatcttcttcctatcttctcctccactgtgtgggtgcccagttatcagacatgattcttgagccattaattagatatcacagctaagggaacagaggagcacaaactgagtccaaatcccgactccagcattcactacttgctgggtgaccttcagaaatgacttcaacctcagtttccatgtctgtaaaatgggcacagcagaaacaatacaggctgacatgtcctgggcacattctatgtgccagacactagcctaaggataagagtcttacaaagtgggtattcttgctgtatctcgttgattccaaagatgcacatctctaaaatcagaatgtgtcctgcaatcattgacagatcatagtttcattggcactacatttctttctttgtagcccataaaataaatggtgaatattcttttctttgagatggggtctcactatgttgtccgggctggtctcaaactcctgggctaaagtgatcctcctgtctcagtctcccaaagtgctgggattacagacatgagccgctgcacccagcctaaatggtgaatattctaattgaaggtatcttcaatgatttaatgaagcatggtatcaatctcattttatagatgacaaaattgaggctcaggggttaagtagagcggggatgaatttaacgtgtaaaaattgtacatatttattgtgtagcacatgatgttttgatatatgtatacatatggaatggctaaatcaagctattgtatttatctcacatttttttgtgtgcggtgagaacacttaaaatctactccctcagcaattttcaagtatataacctattgttattgattataatcaccatgatgttcaatagatctcttgaacttattcctcctgtctaaatgaagttctgtggcctttgatcaaagtctctccactccccatactccccagcctctggtaaccaccattctactcaatttctatgactgacttttttagattccacatataagtgagatcatgtggtatttgtcttttaattaatatatttattttgagatggagtctcactgtgtcacccaggctggagtgcagtggcgccatctcagctcactgcaacctctgcctcccgggttcaagtaattctcttgtctcagcctcctgagtagctgggattacaggtgcctaccaccacgcctggctaatttttatatttttagtagagatggggtttcaccatgttggccaggctggtcttgaactcctgacctcaggtgatgcccccatctcggcctcccaaagtgctgggattacaggcctgagccactgcccctggctggtatttgtctttttatgcctgccttttttcacttagcataatgtcctctaggttcattcatgttgtcacacacgataggatttccttctttttttaaggctgaataatactccgccgcatttatatgccacattttcttgatccattcatctgttgatggattcgagttgattccatatcttggctattgtgaagagtgctacaatgaaccgggggagcacagatctctcttcgacatgctgatttccgttcctctggataaatacccaatcgtggaattgcaggaactggggtttgaatgcaggccacctggatctggaggctatgttcttaaaatccatcttttgcttcttaacaactttctctgagtctctggcatgtcataagccctcagaaagtggtagctgtaatgtcactatccccatcgcctacggcaatgaagattaacgaggtctgctggtagtacagtccatctggaggtcagcagaaagtgttttagtggctcaatagtgtatttagtatctctctagcttctagtgcacatgcacacatgcacctctcggtatttctgtacaccaaaaatcatctttctccaagaagaggggcaaggcctgggaattctccatcttatctgcaggctaccccacctctcccagcctggcctcaggcagtaccctcaaggctgccctttgagtccctatctcaggtgacacagagagcctttggctaagatggcactgtgggtacaagatgtttattataaaccaacctaaaaggggcttgtcagaaacaatgagataaaa

SEQ ID NO: 1460 - DNA, 3057 bp, Homo sapiens
aactggcacggcttctgaccttcaggaatattgtgttcctactgaaggaactaaagccagtatgtagatactatgcagggaggctaaaagtaataaggccaaaagttaggtgtgaattggataaatggagtgtcgtgggaattccaagatgagagaattactgggtgtatttgaaagttcccagtgtttgaggtaggtcttgccaatcacatggaattaggatgtgtggaatgaaaataaaaagaccatattgagctggaagacacaagtgtgtgtgtgtgtgtgtgtgtgtgtgtgtgtgtgtgtgtgtgtgtgatgcattcataagctcatgagctgcagttctgttcttagtaagcaaacatgttgggtatagatgctggcggggcgtcacaatttgtgtgagcactgcataggtattatgggatgtgctttgtgcagggttgtcttgtgtgcatgtgagttgggtgtacacacaggatgttgagggggatgctgtatgccgatagtataattgggtgtgcattagaggtgtgaggggactgtcaaatgcatgtgacatttgacatgtgatggatgttgggtacagtgtgcattagaggtatgttgcagggtttagacttgaggatgtgcatgtgtttttgaagtgcagcagggagacagaactgggctattgaaggcatggaagagctgagacaggtgagaaaaaagaatcacaatgaataccccacccctcctttcctatttccccagtagattcccccttccccatcctcatttgggggacctcccctatcctgaccctcagattgcaggaagtggctgactccacagagtcaatccacttgctggagggggtcctggtgaaagagtctgaaagaccacaagaactaaaagaaggagaaagaaaggtcaaccacaaagtggcattcgccatggtattaaccaattattcatagcacagcctgggaaagtggaatgaacctgcacgatgacagctgacatgctgagaacttgatgccctgggggagacttggctgggacaatgcagctggagtccctcctcatgcccaaaaccaaaacaggccaccctcctctctgcatcaaggcgtgattccagcagccagggctattcaagtatttccttctgcaaagagttgtcatcactccgcgcacatttaagcagatcgcaagcagctattgactctgtttttcgctggtacctctggactgtcagttaataacctggagttcatcttgcacaaattgtagaattggtttatgtgaagcagagaaatgatctcgagctagatgtcagcaccatatcccccggcaagttgctgctcctttgatttcagagatgtaccatgtaagtctttaacaaagtccataagaccagtcagaaaagatgaagcagttaggggacccagaagaaaaactaagtaggcacaaaggtgagttaggaaactggtcaaatcctagcaagccccaggcttccatcgcaaccaaagaagttaaggaggtgactttgtgacatcacttttttcttctttagacagagtctccctctgttgcccaggctggggtgcagtggcacaatcccacctcactgaacctccacctcctgggttcaagcaattctcctgcctcagcctcccaagtagctgcgattacagttgtgtgccaccacgcctgactaatgtttgtatttttaatatagacggggtttcaccaggttggctaggctggtctccaactcctgacctcaggtgatcctcctaccttgccctcccaaagtgctgggattacaggcatgagccactgcgcctggccaaggtgacttcacttctgctgcacaagcaataaaccacctgaaaagagggtctgtttcctaaggatgctatgcacaaagatgttcattgcagcattatttacaacaatgaaatatgggaagcaatgtaaaatccagcaataggaaaatggttaagaaaattattctacatcaatatgtcattttacacccattaaaaacaatatcagacaggtgcagtggctcatgcctgtaatcccagcactttgggaggctgaggtggaatgatcacttgcacctaggagtttgagacccacctaggcaacatggtgaatccctgtctctacaaaaataaaaaattaaaaaaaaaatacaaaaattagttgggtgtggtggcacacacctgtaatcccagctactcgggaggctgagctgggaggatcatttgagcccaggaggctgaggctgcagtgaaccgtgattgcaccactgcattgcagcctgggtgacagagtgagactctgtctcaaaacaaacaaacaaaaaacaaaaaccaacaatgtctatggagaggctaaaataatattcataaaatgtgatgtttggcataaagataacaaagcaggatggtagctgcttgcatatattgtgggtcataactatgtaaaatataaatggaaagaacacacatagaagttttaacagtggtgagatcatgagtgattattttgcctttccctttttaaagaatagcccacattttccaaaattagcttatattatttttataataatataaaccagaggttagcaaatttctttctgcaaagggtcatagagtaaatatttttggctttgcaagccatacagattatgttacaactactcgattctgctgctgcatggagaaagcaaccatgcacaatacattgtaaacaaataggcatggctgtgttccaataaaactttaaataaaaacaagcaggaggttggatctgtcccatgggctatagtttgctgattccataaacctcaatgagacttttgaaagttattccatgttcagtgacatggaataattgccctttcattaagtactagctatcacccggggaaagttttcttcctaatcacagggaggttatgggtccttaggaaacggtccagcccctggaaattgcatttgacaggcagggtcagagacacaaggcatagctgctcgtgaggaacagcattgcctctctctc

SEQ ID NO: 1461 - DNA, 1685 bp, Homo sapiens
tccactgtactattacatgaatgctcacgggctttccatggaaatgagcagggagggggtggcactccagtggatccaattttcctcgatgccatgagagaggcaaggctggcacccaccctctatacatatttccaataggaggcatttactgtgtagagtggttatgtggggtttagctggcaggagaggtaagtgcctgtaccagcccacttcggggagggaattccaattctcatacaaatgcctatgtcagcaccaagttctctctgtgtcacatgccaggggccggacactgtgctcatgacacattatctcatttggggttggagcaattatgacttccattttgtagttaaggtaaccggcgttcccaataattaatgtatgcagatcacaattcaacacaggctggagtgtgatggcagttctggcggatttcaaagctagttcctcatcactctattaattctaccgtaagagttgatcgcatgtgttcccattttacagaggtacctgtgcaaacaggttgtcaatttcagggttagccaaggagaatcaatcttagactcgcaatctgggaggggaggggtaggggctggtctcagccagttctttaactggacactgacaatgctgcctctgccccatggaataatccagaagcccatggctccctcttccagtagagacccactgcacagcacagcccagcctcctccaccatcccctgagctcatccagacagcgacccggactttgcctcttaggcctgatctgtgttggcgtccaggcccgttgattttcctgcatccctgtgattagtgactaatcttatttttttgttcccaaacccataaatcggttacagaccaaatatttacacaggccatcatttccgactgaaccagagctcgtgacagccctcattattaaaaaggatgactgattttgggcagagatttcacggccatgtggctggatgttttcttttaggtttccttcctcctccccttgcctgaagaaaagacaatttccaagataaattggcgcagaggtctgctctcactgtctccccggggctgatggtgtgggcaggcttccatcagcccagtaagtgatgggcccccagagaaatggccagtgctagcttctgcccgcatctcctggcctccctctggggccaaagagtggaacagggagtcatttgactcacaaacattcccgaaatcagaggctgtagaagacagcagaggggaggggcccagaagaggaaatagctgcatccccacctccagcccatgtgacccacagggcagggagtggtttggcctgtcaggtgccccacccccaacccaccaccagaggccacatgttgagtggataagatcactggacagagaagcaggaggatgaattcctgacctagctctgtcattacctaagttaccttggattttaatgctgattccccccctgtaaaaagcaaagatttgcggaaggtccctttatatccctttttgcttcaggtaccttggtcctaattatgacagctgccattcatttcacccttcctacatgcctggctttgtgctaagcatttcagaggcatcagctcattttattcctttttttttctttttttgaaacagggtcttgttctgtcatccaggctggagtgcagt

SEQ ID NO: 1462 - DNA, 2510 bp, Homo sapiens
ttggcaacctgttacacttaagacctttaatgatgtgagggctgttctgtggatagaaataaaatagctgatacagaaatttcttttaatagaccttgaggtaagctttacacttaaattataaggtgaaaggaagaaaagctgctgtgagttcattctcctctcttcccataccctaaatgacttatcccattaaattgaattctgaaagctgcaaaacaagatacctggctattgtgtgactcttgtgttactatgtatacctctgagtgtatttctctatcatgggagattgtgtaagatctctatgttgtagagatcttaagtccttgtttcctgccaaagcccctctcggaatctatccagccagatggttctcttgtgttagtccagtaggggggctttaaataaagaaatccaacacggacaccactggaaagtgtcccagggttggaagataatgaggaagctgatttttctcatgcaaagacaaaagtgacatcttcttaaaattcttaattcaatttgaagggagaagtaattacctcctctggccatgatgttgaaatgtccatagagaggaaaatggacttcaccctcattaactccgtggatcagagccaaaagcagcattagccaaaaaggcttcttcaagggcacagatcccctagatcaaagcatgttcttgagagaatagagcatgaagttttgtgagtgactccagttagaatcacatggagacttttctatttttaatgaatctttcttgtattgtagtttatgcaggtccacagttgggaacagggcaaagcagggatgtggcatctgaaatgattttttctgtcttcattgattcgagcctgtgactgtggctggcagctgttctactggtatttatcttggaggctggtcacaccatcaggctctacagcacagaaaaacttcatttttactctctgtccagggccttcagacactcactgatacctctgttcatttgtggctgtagataatacctaacccaatttcagcttacaaagccccattgagcaaatgcaaagttacaaagtgcctccctatacaataggaaacagcccagcctgggaacattgtcacaagcattaataggtcactgtacctacacatcactgcatatgctattgtgtgcagtcattccaactctcctctaattagaggggtgattcatgtcaggggcataaagcaaatattactttatttttccaaattctagaaagcaagcttccatttttgataatagaaatttgggaatgattggcagtcatttggctcacagggaaagcaggaaaaacaagaaatctaaataaatctcatattgattttgaagaagctttcttgtgacatctggtatgctttattttgtatgtatcaaatccgaaaataataaacaagttgatgtaaacaaatgcttgaagtaatgctcaaatggcagctggatacttgaagacgacagtaggaaatttagctttattaacggtgcatgcttgtgcacagtacaaactttatacttcctaaatgttgtctgaataaatgatacacaagcatcaaaatatgtttgaaaaacataaaaaatggtagaaatatgagattatgtctgagaaagcagctcagagtggggttctaaccccagctttctgattagcccactcttgacctcagattgcatcacataagccctctgagcttcagttaaatcctttatcaagcaagggacttaactctgtgacctgggaggctctggcttcctgtcactgccatgaggctctagtacagccagagatacaggggtctaagaacctgtgtttaggattttgagctggtttgattcaggtaatcatgttctatctctgtgtcctaatctgtgtttaaggttttgaattggtctgattcaggtaatggtgttctatctctgtttatcaggatctttacccctgataaaaatccagagatcacttgaatgcaggtggttttctcttcatattgttcaatgaagaaagcaccaattaaggattcataataaaccattgcccagtgagaaattggcctggggttccagggtgaagaggacagaagattttcattgggagcaccttaatgaggacaacagatcctggcttaatagagaacataaagtaataaagagagacaaatccatctatccattcattccacagcattgattgagtgtccgctgtatacaatgggataaggaaaagatgtccgttggttcatgcgcaatgatggtaacaggttttcattgctgaacattacatatttcctttttaattttaatgtttaattttcgtgggtacatagtgggcatatttatttatggggtacatgagattcactctaataaggtgtagtgagttccagggatttcagagttgatcaaggaaaaccatatggccacaaggtggcagtagcgcacaatgaatttgttcaggcttcgctttgacagatttgccagc

SEQ ID NO: 1463 - DNA, 1496 bp, Homo sapiens
gaaagggaggccacggcatggaagaaccttgaggacattatgctccatgaaatcggcccgtcgctgaaggatgaatactgtagaattccacttagcagagataattagagtggtcaagttcatagagacggaaaatacaagggcgggtgccaggggctgggatgagggggaagtggggagttcgtgtgtaatggggacagaggtttagttttacaagatgaaagttgttctggagatggatggtggtgacggctgcacaacaacatgaatgtgcttcatgctgaggactgtacccctaaaaacggtgcagatcgcaaattttatgttatgtgcaccttaccacaatgcaaaagaacaaataaaacgggaatatatgtatcaatgcatagcggatctctgggaagctctacagtgggaggggatttgaggaattaagggtcagggatgggagaaaacctaaatttttgcataatttttgttatgtttgaaagtctgccactgcatgcatgggtcccatttaaaatgtctattttaagtgtcaaaaaagttaaacaatgaccatagccaaacatactttatcattatatattattataaatacataatatatgcttgtatgtgacttatagtataggcatctattaatatattgtgtttttataaatatataatatatattataaagatctatttagccgtatatatttagcaatctgtgacctactttgcaagactagaattctcctctgttatggttagaaggattattaactacagggggaaatgggatttgggcttgtatttttccactattacataagcaaataaaactgccaagctgctgcctttatttaaatattccttaatgatgtgtgagacttttcctctgtatcttccttgttttgttctctctctctctgtctctcaaaacaactgtgccttttgtggaaagaaaattgtggcaaatattaaacaggaagctaagccagcacgggaaggaagatgtttgtcttacataaagccgatttaaactactctcatccttgcctcatccctgaagccacgtctggctcatgctgtggggagcactgtgctcagactcagcaaaagccctccctgctgcctgggacaattcctgcctccctgagagccttcctgggcagcacctgctctcctctggcggtgcagaggtcacaggacatgggaaaaaacagagccaaggacctggaaaccctgcttttcagtgactgctcttccgttttcacttagagccatattcacagatacgttgggccataaaggcggaaggagaatggaaagggaattgcccagtgtggggatgcatcatgtacagctccattcagggaatgcgttcttgtggtgctgtttccagtgggtgttggcagcagtggatagcactggccaaataggccttattgcccaaagtattacataagatggtatcttagttcatccaggctgttataatgaagtgc

SEQ ID NO: 1464 - DNA, 1675 bp, Homo sapiens
ggaagtaaacattgtcggcctcaaaacacgaaggtcttcaggttgcttgttactgaggcctaacctggataaactgtgtcttaggaaaaccttctctggctctctttcctgttaggatataaacatacaaactaaaagctggaataagaatatgtggatgtttacccagctctgattatataagagacaaattgacctggttgtcatgagaaagattaatagagtagaacagagataattttccagattctacagcaagcactggatgaaaaggcagagggcacatcttatttttgacaaagctaataattattccatactggtatttttttttctatatttttacactaaaaaaccctgaaagagcaacttatggattttctaacttcaggaactaaagatgaggattaattcctctgcctttacaactgtaaaatgggatttgtctaacaagggattaatcactatgttccccctctctgattgcccctctgaaatggttctttcttccgtatttcccagcctcttgattgactcccaagcacaatgcttggcagcccactcctgggccgctcctttgttgacattgcatcttggcacttagcagcccacatgctctaatgcggtgatttgtcagaagccaggtgttccactctgtacaacacttaagcaaccatttcacagccattaccagtctgcagtaatgacactgggtgaaagctaagtgctaaactggttgtaaactacaaagaacaccaggggaggtgaagacagacactttgataaacaagaagggacagcttgtaccttctaattgatcagtttaaatctccactcagctttcctctcactacttcagtccacttggtgttcagcagatatggcagattgtatttccagagatgaccacaacagtatatacctcctaaccctagcacccttcctcccaacaggcaggaggaggaggaaagcttgtgcctgagatagaagtcacactatgaggctgtgagttctgttatgagaggaagatcagcctccaccatcctcttgtgatacttggagctcaaagccaccacttaagaagctcaaggccaccatattgtgaggaagccccaccacaaagtagtgccatgaaccagtctgaaaccccaacgggggtcccaggcaagagccagcctcaaccattgcacatgtttggagtgggccttcacaggatcccaagcttcagggatctgccagctcctccaagacttcctggctgaggccccagccattgtggagtagaggcatctactaacttttgtccttccaagttcctgacccacggaatccaggagcataagaaaatggtggttgtttagagcattaagtttgtgtgctttgctatgcagcgagcaaaagtggaacaacagtgttctgaagtgaaactggaaaatcattgcctgcctgccctgggtctgcacagaggccaggctgggcttaggaaggcatgtctctctcttgggagtcattaaatagcagctcaggggttgaatgtgtcctacaaatattgtccctaatgtaattttactccattttgatcatctgagccaataatttaaaattaagacatttgctttaaaaaaatccagatttttggcttgtcttggaacataacacaataacacttgaccta

SEQ ID NO: 1465 - DNA, 8538 bp, Homo sapiens
attcttcttgtttgtgtctgttatttctgtagtagtcgcagtaggttggtgaagtctttgctagtaaacgtcgccctaaacttaaaaatcataacatcattctgcttctctgaaacaatagctgcaatttctcaggctcttgaagcactaggatttcaacattaatgcaagtgctttagaggaagaattgccaccacatttacatgcacagatctctttccaaagctcttcaaatgtacaaccctgagagccccagaatcagtttaaatcaattcggaatgtgcaggtaagttaacagtgttgagcatccatctaccttcagagggtcagagggttggaaacacactagaaaaagtctcatgttcagagacacgaatggtcaataatatggttataaatatcatcttaattctgcaaataattttactattaataaattcctttgccacatacacatcctcctacagtattcttagaacactcccatctgatggtgttggacttgcctctttcctcacaggatctatgtgtgaacaaacgagaattatattccaggcgtacttgttttcattgtagggccctgatgtgcagagggagtgctgaagagacaaatgccgctgggaaaagtggcctcatttattcaagatctgataggtgtttccattggaaccaaatgttcagaacgtctgcacattagaatattttggtttgagcccaaatatttctatttgagatttatggaaaatgaagacagtggatggcactagaccagcgtgtaagcaggagtaacatctgtgatatttagcgactggctaaatgcttgctcgctgtaagttgtgtccccacatacgagcaaagatcacttctgcctgtgtggcagaaagggtcacaaattctatctgaaagtctctgagcaagccacaccattctaaacgatcatcacatctttgagtaatttgaacagaatttgatcttttatggttgttttttccccatcccgttccctcttccagcattgaagcccttgaaatcctagatgattcaagagccctggaaattggagctattatttcagagaagcagaatgatgttatgattttcaagtttagggtgacattaactagcaaaggcttcacccacctactgcaacaactgaaaaataacagacacaagctttggaagacctggtaactgaggccatccccccgtgagaccacgagctggcatttagggctcactctgtgggaaaaactcatcttgaaatcctgaaactactctctgagtggaggaagctcattccaggaatgttaagtgcaaacttaataatcaacacagaaaaaagcaaaacatgtgtcccacctcacgttcagtctgggccacaaatagacgctagtggaggtcaccgacttatttttaaaatatttttttttcaatttttaaagtaacttttaaaaatccattttatttttaatgtttttcagacttatttattctcataaatccagagataaaaggcggagcacaagattctttgcatgccttagggctaaggtaagcccattttcggcatctgtgctggccatatgtataaagcctatataatttccatctctttttctctttctctcatctttgttttgtctctccccttccttggaaagcacattatttgaagtctgttcggttgaaaagtgtatcattccattccctcctattagcaggaagcatcccctgggtgaattgaagatccatccttttctgaccttcccagtcttctgggaggctcgccctgaagtggggagtgttgaggtgtagagcagaggaatgtaattttcatgccactgtccatacatggtgaggaagccattctatataaaatgtcacgctgaatgcacacaggcaattttctgagggatggaccacagctttctgtctaacctcaacatcatctatggcaccagcaatggcaaacaaaggctaaaaaccagcagtgtgaatttcatgaggcctgagggtgtttctttaggcccactcagtggcacgtttattttcgttgccatcgacatatcatgaacttccacaatcatgagctttcatattaaaattcaactttcttaattcccttgcaccagctgggatcagtgggctcctagggtgaagaccactgagtgctgctgtgtgtaggcgccgtcctaggggccaggattgcagcaatgagccaagcagacagcgccctggccttcagggagctcccagccaggttggtcatcctcagcctgatgtactcctcgctctacttagtatcagactctaagaaccactgctgctaccgagttcccatctcaactctgccactaactgggtttgatgtttgcatttgtatagctttaggacttgagctttctcataggtagaatggaaataacaaaatctacctctgtgggatttgtaaggattaagataccctgaggatcacgtagcgcacagtacatgctaaatcaacgttatttcttgactccaatcaccatcattccctcacttcacaaatttgtcaatgaacattgtatgcactaaaccaagtaacttttagaaaccacagagtctgtttagatttacagctttcttcatgtggtgtttgtgtgagggcctttgaaacgcaggccagaaagacagccccagccaggaaccaacccttctggtgcctagatctccaacttccagtctctagaactgtgaggaaatgaatttctgttgtttaagccactcagtctatcgtatttttgtttcagcagcctgagctatcttatacaacaccttatatggaatgtgtgttagcaaaagggaccacctgactctttcttgtggtcagtatttaagccaactctttaaaccaagtgccaccatgaacatcagataaaacataattttatcactcgaaatagcagtttatgattggcgcagttttttgttttctaaattttaaccagccctcttccctgtctttataaatcagaattcctaagaaatagttgatcaaggtgatagcaaaatatggctactcaaatgactgtgtgtcaaatgcatggtgccaggcccagtttgtgcccctctcagctcagcatccttccaccccccaggcctgggctatgtccaccactccctcttcctctgaggctcatgctgccctgcctcctccaggtggagggctggatgcccaccagcttcccttgctcccgttatgggagctgcagcgcccctggggcccacatccgacctgcctagacctgcagaagctctggttcctctgtctaaatctaggctccaacgagaccctgtactgtgggtgtggagttgagcttccgcagcagtgaccccataaggcccagtagcaatacaaatgcacaagggaggtaacacctcgtggcgaaaatggggcctgcttttgtcacaagggaaaaaaaaccatacagaaaagggaactgtaattaatcagcttcctgaaaggagcgaagacgaaccttcatgggtattacgtgtaatgttgtgtttcttcccacactccaggggcatgaaatgctcttcatccaactggatggtttcatgttgccataagaaataaagagagagtggccaggcatgatagctcacgcctgtaaccccagcactctgggaggccaaggcgggcagatcacctgaggtcgggagttcgagatcagcctggccaacatggtgaaacccggtctctactaaaaatacaaatattggctgagcttggtggtacatgcctataatcccagctacttgggaggctgaggcaggagaatcgcttgaacccgggaggtggaggttgcagtgagccaagatagtgccactgtgctccagcctgatcaacagagtgagaccctgtctcaaaatgggaagggaaggggaaggggaaggtgatacaaagaaagcatgaagagaaacagtgacagcatgagctccaggggcatcggaatgtgacgggcaagttgcagaatgatgaggggctgtgaggccaccaggatccccgctggtgcagtgagagggtctgtgcagggcactgggagctgtgaaaagctttgccccaaatcaggtgaaattcaaccaagaaaatgccactcaccctcctcattataatttctatccccctgccaaaatgtgaaccatgctactctgaaattccttcatttattctgttttgacccttaatttatagatattaacattttggcttcttatagttgatcaaagtcaggaggaaagagagactaaagggaagtaagtagaagataggaaggagagaaggaaaaagaatgtttttctttgaaaggaacttgccatgtcaccgagggcattagagcatctctgaattctagcaccagctcagcagacaagctttgtgaccctgaggatattttatctcctttctgagcctctgtttccccttagttaatggaaacattgcacttagatcatcctaaacttctgtctcttaatctacagaaagagcgaagttttatttgcccgaattaaatggaaagtagaaataatagttaattctctttcccaaaacctcagtcctatccatttcaagaagggccactttcctccagagaaatgagttacaaaccatcccagaggtgtctggcaaaccgggagagaatccctgagttcatatcagctccctcccaaaatttcatcaacaggacaaagcataacagagctgaacgaagtagaggccaccagggcaaagagtgggcatgaggaccacaccagatgcctcatcacacttgggggaagagaaatgctaatgaggcaggggcaactgggtttgcggagcaatacacagcagctggatcctgcagggaaggaggctgctgcaggacagaggaggggcccgttgaaggcccagccaaaaaaccttcagatgagagggcaggctggacaaggcaggactctgaaaacagaagagacggttaaacctccacactcaaccaaccagacccctcggacaaggcccccacccaggcatcctggcccaaccactcggggcacagggatgtacacaagcttgaatatgcgggaaaccaaggcactgaaatggtgtaatctctgaattcatcaacatctggagatacaaagctgtggcaaagagtaggaatgtgggtgaaaaggagtattgttgttttctcttttacttgcacggactcctggaattggactttcctgaaaggtagcctatgagagctctagcattctccatttaacctactattgcctgtgatctcacaaactcccctgggatcaattccaaatatcagattagaagctttgtgagggtagggattttgtcttttatatatttacatcttcaaatgcatattgtttagttgcttgcgcagaattgtaagaaacataaagaataaacccatgaccctctgatctccacttaactatttttcaaaggaaataatcatgatttttcagcagaagagatatagagatatagctataaatacagatcatcaaactgaaagtagaagaaaaatcaacgtggatgtctcaagtattcaaaaagactttggcacacaaaatatttaagcaaagtatgactaagcttatttcagggagggagaaatgtgaactacaggatgaattgattgactcatgcagtgaacaagcattttgagcataaattcgtgccagacactataccagggtatgatgacttaccaaggaacaagacactggtctctgctctcggggagtcaagactctttctgaggagttggcaattgacataaatgacaggtagccaagatagggagggacctaggagaagagcctcccagttagacggaagagccctgggcagaagggagtctggcatgtgtggggaacaggggagggcaatgaggcagggatgccgtgagtgatggggaaccacaggagatgtcagagagaggaacagcagcgcatgtgctgagcaacacggaggatttggggttttgctctaaaccccgtggttgcaaatcacggatggttttaatcaggaatcaacaattttatttttatttcaatagttttcagggtgaacaggtggttttggttacatggataagttctttagcggtgatttctgagatttgggtgcacccatcacccgagcagtgttcactctacccaacgtgtagtcttttatccctcaccctcgtcccacccatccccccgagtcctcaaaatccatgacatcattcttatgcccctttaagtcctcacagcttagctcctacttataagggagaacaaacaatatttgatttcccattcatgagttacttcacttagaataatggtcttcaaccccacccaggttgctacccataggaaaagaagccattatgtgaaaaagatacttacacacgcacgtttatagcagcacaatttgcaattgcaaaaatatggaaccaacccaaatgaccatcaaccaaagagtggataagtcaaatgcagtatatgcaatatacaccgtggaatactactcagctataaatgaaggaaccaacaatttcgatttgtatgctttgaaagattttcattgctgatcagagaagactgtagagggcataggttgaagaaaggagaccacttagaagtctctgacatgtgtcaagcaagaatatgatggattaggtcagagtccagatgggaccaagggcagcaggcagcagacagggattgggacacattgagaagaaacatgatgttgcctacattttcaccctttagcgacaccatagggagccacacaatcttttatccatgaaaattgctctgtaacctttctaaatctaacaaacaatttaatctttctaacatagggtcatctattaggacatcacttgtgtctgaaatccataaattagcacagagattattttttgcactatttatggtattatgatcatgaagcaggaaacttctccgacccctttgcggaagggaactggagtgcgcaggtgctagaactagcgggctgcttcgacgccagcagggatggactccactcgctcagtcccactgtgttccaccctttgcaggagggggagcgcaggtgagcagatgcaggagctggggcgagtgctttttggtaccagcaggagcaaaactctgtgtggccccgcggcagcatctagggggatgcccacgacccctgaagccccagtaggagtgttacagctcttttagctttgccgtcggtggatggcttaagtgttaacagctcagtgaagggtcaagtgtggcagtcttttgcactcgcacctgaatttttgtctggcctctaggaggaatgaggtgacatgaacaaattggagatggtaaatgtgggggattttattgccaatgaaagcggctctcagcaggaaggggagctgaaaagggcttggagtgggaatctaatctttccccggagtagggctgtccccggctggactcctctccaaagcaacaccatcaagccgtccctctgaagtcaagctgcttatctccgatgtccagctgcttctcctcttctcctctgctctccataagtggagcctggggtttttacggcacaggatgggggggcagggcaggccatgggtagttttggaaaaggcaacatttgagcaggaaaacaggaatgcatgttcccactttgggccatggtataaggctttttggcttgagggtcgggccctcaccagggatccaccctcctctgcccagaatttccctgcctcctgtccttatcagtcataattctgttttccctgcaaataaacatcttgtatcctccatagcatgcacagtgtctaaaccagaaatatgtttaatagatgttctttaaaatgccttttaacaactctacaaatattcaggctatctgcatctataaattgctgcatttgttttcaatggaaagaaattgaaagctggcaattgtcagagagtcaaaagtactaagacctttaatatttcatttctgatatctatattctagtgacatatctttatttcattctccactggaagtgttgtaagtttaatgtcaattgcatacatttatttaatttcaatagcttgcataatgctgcccagcaaggcacaatcaaattaggagtgtctggtcagaggcagggcagacaagaggaggaaatcagcaggtcctatctcattagaatcacaaaagcctacatttttatgtgagttgtgtcaggaagcatggcctgaaaatatattggtcaaaaattaaaaagtgggaataaaactatggaaatatacctgcagcctgacaacaaaagagaaatggacctctaacaattttgtagactattaatagatgcctattaaatatagcacatcaaattacatgtttcatctttttaagataaatattggttttagagcaaaacagtagagaataatacagctattcattctgactcactgtcaagcaacagaggtggtgaaaaa

SEQ ID NO: 1466 - DNA, 7580 bp, Homo sapiens
atgcccccatcagccgcctggtctctcagggtctgccgcgactgccccattcctgattctagtctttgctttttgagacaacagagcacaaattccatttcagaggcaaccgtgaggcgtgcgacatggccgcagatggggtttatttcttggatttttctctccagtgtcccgtctgatctgagctctgttcattagaactcagggtgtttcttgctgattgagtgagaacggacacagagccctgaattctcctggaggctgctcattggaaagtctgctccaattcactgcagatatataaagcctcgcaccagactgcatctcgggaaacactgttctgctctgttctattttgtcctgttctatttcccccaaaggctgagtgcggagcttcctgaggcaaaactcctgtggacccaccaggaagctggtcttgaaagatgctgcaccagacgactcgtccactcactagagactcactttgccggagaagggctcgggcgtcgttggaagaacccaaagccaggcatgaaaggacctcagccagggagggcaccgcattcacacaaatgctgcgtgttcccatggaaacagcacaaaacctgaccgaggaaatgaatgctgaatgtaaactatttgtttaattttaatgggagtcaatttttagcggtgtattcccagtgctatttgaaattttcatagggtaacagtaaatgcctctaatctttttgtttttaattggcttttccagtggactgattccccgtgaataaaggggagaaacgcaaagcaatgtaaacaaagccaaaagcaggagcaacgccagggcaaacggaggcagagtcctcgcgtatctgtgatcagcaccggcccatcctgggtgcaagagagcccgctgccaactcgcccccgtcacagcagctgcctcagcctccccagccagctgtccctagccctggacctcaccacccctgccagcccgtgccatcctcagtttcggggctcactgcggctgccgctgggcttgagggaagggcagtggtgggcgggagaggcgggaggcccttctatggtgcccgtggagttgtttcctgtgtggggtgcaggctgcccagctgtgttcactgtgaaaatctacccggacacacattcacaactggtaaattgaacttcaataaaaaggtaaaatgtaggtcactccctgagctgagaaggaagctctcatttatgagagggaccatgatggaccacgcgccatttatgagctgctcaccgcggacagaccgtgtgtccaaatcggggcctccagggcccagcgagctgctctgacctccgaacgtgagacagagctaccgccagttctaagagctcctctcctctccctctccctccctctattttctctcccccatctccatttctccctctcccttcatttctgtgtctcactctccctcccctcttcaccctccctctccccctgcacttctccctctccctccgtttctgagggacatggcctgagcgctggcacatgccatggtgagccccaggggaggacacaggctccctgccactccccgcaggggtcactgagcacgtggggaataaatgaggggacttggagcctgacggtgctcgtctcaggccctgctcccaaagcctggtccacacccagcagcctccaccgcgggactgggcaggctacgaaaggggagcctcgggcccctgaataggtctgtgcgctccagggcaagggagaagacctggcctggctcaggggcagagaactgttcttggggctctccggagtcaccactgctgttagcagttaggccaatgggcagcgagacccatggggagcgagactccccgtggggagagggtcccgttccccgtctgcctgtttcgggggggccagtgtcccagcatggtggctaaggtggagtcacataagagtgacagagaagagacccaaatctcctggcctcagctgggaagcagcctccccaccggctgcctagacccctgaggctggaggagcgggactcacaggacagagttgaacggaggcctcaaccccgcaggcgcaaccgagttgttttcagggctcagggggagggagcggacagaatctcgtgttcttcctgactgaagctggaccccgctatgacccctccctatactccaccatccaccctcctgaaagataaatggcctggagggcttcacccgcagacatgaaagacccaggggaagagctcggggtctccctgctcccttgatcaagcagcccagaggttcccagcccagggaaggctgtagagcaaaggtcattgggtggtcgccggcgaccagggaaaatcagtgtccaccctcaagcaggaccctgccagcctgtgtggctgacccctgaaggagggctcactggatggcaggtttgagggcgatttgcttgggtccaggctggggggttctgcctggcccccccagccagcctgtcctgagagtgggctggtgctggcccggcgtcggcctccgtgcccacctcctggcaggagggcccttggcgcaggcccacaccttgcacctcggttacttgaggcacaacccaaacaggcaggggttctcccatctccaggttgtgagcttggcgtctccagggaaactgccccagcctctgccagcaccgaggaggcagagcctggatccataaaggaactcaagccctgcaaaccccagtactgacgagccacctccccggggcactgtgccctctctgattcccactccctcctggtgctgctgagccacctccccggggcgctgtgccctctctgattcccgctccctcctggtgctgctgagccacctccccggggcgctgtgccctctctgattcctgctccctcctggtgctgagccacctccccggggcgctgtgccctctctgattccccctccctcctggtgctgctgagccacctccccggagcacgatgccctctctgattcctgctccctcctggggctgagccacctccccggggcgctgtgccctctctgattcctgctccctcctggggctgagccacctccccggggcgctgtgccctctctgattcctgctccctcctgggggctgagccacctccccggggcgctgtgccctctctgattcctgctccctcctggggctgctgagccacctccccggggcgctgtgccctctctgattcctgctccctcctgggggctgagccacctccccggggcgctgtgccctctgattcctgctccctcctggggctgctgagccacctccccggggcgctgtgccctctctgattcccgctccctcctggtgctgagccacctccccggggcgctgtgccctctctgattccccctccctcctggtgctgctgagccacctccccagagcacgatgccctctctgattcctgctccctcctggggctgagccacctccccggggcgctgtgccctctctgattcctgctccctcctggggctgagccacctccccggggcgctgtgccctctctgattcctgctccctcctgagggctgagccacctccccggggcgctgtgccctctctgattcctgctccctcctgcggctgctgagccacctccccggggcgctgtgccctctctgattcctgctccctcctgggggctgagccacctccccggggcgctgtgccctctctgattcctgctccctcctggggctgctgagccacctccccggggcgctgtgccctctctgattcctgctccctcctggtgctgagccacctccccggagcacgatgccctctctgattcctgctccctcctggtgctaagccacctccccggggcgctgtgccctctctgattcctgctccctcctggggctgctgagccacctccccggggcgctgtgccctctctgattcctgttccctcctggcactcctgagccacctccccggagcacggtgccctctgattcctgctccctcctgggggtgagcctgccccatctagggtcgggagggcctcacccacaggcagcctctcctcactgccagtaaagctctttgtgggggccaccacccaccaccctgggtcctgtcttttccttgattggcctggaaatcccctaacttgtctcactactagaagcttccagcctagatatccgatcaggatgggccacacctggcttccaatatacaggaagtgaaagcttcagtcctagtcattggcttggcggccgctgaccagacaggactcgggaaggttcggggacccaactgcacccaggggtggggcaggctctggtcctgtcattttcccatcccaggagtgggagggagctctgaacctcagcctttcacccccaagtggaggtccaaccccccaagtgtctggcctcagaacccctcaaatccaagaacccctctccagaaaagagcagtgctggggtccagcccgtggccctgaccacagcacgcagtggcccttcctgtcccctgaggctgcctgcccagccagaagaccccgcctgcactgggaccaccctgctcacctccctgggccgccccaagccaccctagtgcctggagccacctggaaccctagatcccagggcttggtccgtgtgtcccagggtggccacttctccagagagaattcggcttttctgccagccctgccgccctctcctataccactgtggatgctgcagggaaagacccccaccctccttttctctgtgggaggctgactgggctcaccggctcagcagggactcctggacatcctctgcgcctggaagggactggcatacagggaggggccctgcggtgaacgcggggtcctcctctctgggctgctaataattaagggatgacaggactccgggactcacttccactctgctgctcagacagccgggctggggctcgggaacaggaattgaacagaggttgcccagggtattctcgtgattagggcccgacaataacctttgtgatgtatgagagtgagattacatttcagttatccagggccaaggggccacagggccactgcacacgttgtttctgccgatcctgcggcccccctccctgctcccaccatgctcctgcccccgacccattgcccccagaaacccaggctcaaccctgcctgcggcatttctggatctctgcgtggatgcctgttgcccgtcactgggtacccagacaaacatcccctcctggggaggcccccatcctctgtctaaagcagccccttccctgccagtcctccccccacccatggagccacagccctgagcagcgagaagcctggaagcaaagcccccactctccctcttccctcctcgtccaagcccaacagaagccagaggctgtgggagcccagggatgctgggtgtggaggtcggctgtagagattaggacagagcagggcagagatgagagatgtggggaggagatggggtgaactctgcacccctccctcatcctgcatgcagcctgccaccgactccctccccattcccctacctggctccatgggcctctgagcaaactgctccatgaaattgcatttgacaagtgggtgcgctcccttcctggggggcctctccagagccctttatttattatttatttatttttattctttagagacagggtatcgctctgtccacccagtctggagtgcagtggcatgatcttggccaccggcccaggtgatcctcctatctctcagcctcccgaatagctgggaccacaggcatgcgccaccattcctggttaatttttgtattttttgtagagatgggttttgtcatgttgtccaggctggtcttaaactgggctcaagtgatccacttgcctcagcctcccacagtgctgggattataggcgtcagccccctcgccagctccacgtccctttaacccagagcgtggttatccttgacctgcacacacctgctaggggcactgacggtgtctgagctttacttacaagcaggtcctgagctaagtccgtacagggcatctcttacaccacactccacagcccgcagcctcggagccccaacctgccatggagagcagccgtccctgtgccctggtgtctgttgttggctgacctcacctggcagcagctgctgagtgggtactgctccctccacgcccctactgagcccagcggctgggcccacctcaggtgatggtgtccccaggagcagccagatgtcctccacaagcaccgtatccacatcgagccaggcagcaaagtgggagcacagacgcagccccacaggcgcaatgggggcaggtggggatagggactcctgtcttcccgcaggcccgcgggggcctccgccactgcttcacacggtccacacctcccaacccccgccccctccccgagggagcttgaggaccctgggttgagagagaccccagccctcccaggagcctctgcatcttgctggcaaagtcacctgcgtgggcaagaagaggcacagacctcagctggggctgcctggagagcccgggggtggcgcaggtagaagcttctggagagcgggagtgggcaggctgcagctcttgctctgggggcagcacctggcccagcccaagagacctgcagaggccggcagctgggcctgggtgcctggaactcaagagaacgccagaactcacgggtccaggtatggtgtggcccctgcgacacccacaggtgtgagtgtgcatggagagggaggggagggcaggcactctgcaaactgtgaagtgcggcgcaccctggcaggtggtgggagcacctttaacaccctcacctgcttctgctccttgtggggtgaggggtggctgctcctttctccagaccctcctgcagaccctgataggtcaggacctcctgcactgggggctctgggagcatctgaggtcgtcggggccggtaaagcctgcaaaaggctgagcctccctcctcccctgcctttcattggaaagtcctaacagccacatatttcatttgagaaataaatattcattaaaatcatataatatggatttatgactgcatttgaggggaaattaaaggaataaataacccataggtctctgaatttgttgtccttaggcggaaatgtctccagcttggtttccaagcttatttaaatgaacttgcctcacttgttaggaaatatgcttaatttctacagttccagaatccttttttagtttaaatttttatgtaaaacacatgggtttaatattctgttgaaagttcagtaaactcaaggcaaataacattcttaagcaactttcaaatgattccgcaaagctctgacataaatgagcacacctgaccgcgcagaacgctgcccctcccccagccgaaggagtccatggagaccctatgaggtcagagcttgagtgggggtgactgcgggtttgcacccttggagcacgggggagtttcactgaagtaccaggaagacgtgttctgagctgaatcctgggttcccgtgggg

SEQ ID NO: 1467 - DNA, 20846 bp, Homo sapiens
agtgtggcgattcctcaaggatctagaaccagaaataccatttgacccagctatcccattactggatatatacccaaaggattataaaccattatactataaagacatttgcacacatatgtttattgcagcactattcacaatagcaaagacttggcgccaacccaaatgcccatcaatgatagtctggataaagaaaatgtggcacatatacaccatggaatagaatgcagacataaaaaaggatgaattcatgtcctttgcagggacatggagtttattttttaataaagttaacacaagattaaataaactattactattttaaaatataaatagcatattgaagtaaacccttcatgtattaaaataaacatttttcagtattttatatatactgaaaaaataaatatgaattatttttaagataaaagaggaatagaatttgactttccgtattataaataacatcaataaaaaagggcacaatgaatgagtcaaagtattcctgtagattataaaaatcgtgaaattccgaaaagatgaaaagaagtatattttaaaacaaactgaactcccagtcagaataatgatggcggctgaaactctttatgctagccgccacttaaaaaggatggtttccacgtccaggagaaattggtttcatacatgcaaggactccttccagtctgtgctaaacaaaataataaaccaaataagaattgacttctagtgagctgggaataaacacgtactttaaggtaaaaaatggttctctcccccatcagtttaagtcagttcctctgggaggagtgcagctagagttaactgaaagatatggagagacacagaaagatagttgagttacgagtacgaataggaagttggttgtctgttacaagctttgggaagtactttgacaactggagaatgagtgttgtcagtgataaatcatccctgatggaaagctgtcacgagctatggagagagtgtgtggtttatgcagtgactggagtagaggagaatgagcctgaagcctacctttgtgttgttcatctcagaaaaaatgtttttggccgttgggcaaatgagttaagtctcctgtgctttggttttccaagccaaagcatgtcaggccatgcccaagtggcatcctgatgtttttggcaccggcaggtgcctatcactcatagtttaacaatctcagcaaaatggacttgcatgccacaatagaggtgttctctatgcatgggtacgccagtgcatctatcctgtgctaaccatatttagtggcgctcttgggagacaatcatctgtttactaggcaggtgggtgtagtttgctggcctttcctgctaatgaatgtttcagtagatgcctggtcatctgcaaagctgagaggtgaagcatttcttgacattaaacaacatttaaatgttcctcagtgtagacatattgtctttgtttattcatcaatcccgtatcagaatgtggctgtgccaacccaatcactattttggccactgttataatcaataccaattactctggccgacttgattgtataaagattgtctttgagctagaaggtattctaatttactggaatgattgtgctaaactgagctggttgctctttttagtggactagactcatctaaactagtagttagttgtttagcattgagtactgtcttaccgagctatggtggaaaaggcacaaatttagcaatctggagacccacatttgagttgagtcacataccttctggtcatgtgatcttaaaatatctcttaatcatcctgtgtctcagttctctgtctggaaatcaaaaccaattatttcctatgatttcctttcattaggcactgagaattttaaaaccttagaatacttggcaattaaattttgtactcagtccttttcacatccccagtcctgtttatctgatacaaattttcctcttcctttcattccgtcttattattttcagacttactgcaaagtattttatgctgtgtaacatgctcgtgtgttttttgctcttattagcaggcaaattataaatagcaaataaactaggatctgaattattttcccaatcaagtatctgcagaaatatagtttttaagcatgtgaaaatattttgtaactgaaaagcccaggtatacaatatttatatatagtatagatactacattactataaatctgtgtgcatacctatatacatacatacacacatatgcatgtgtgtgcatgtttacctattgagaggtgggggagagagagataagctaccaatgaaagtatagaagagacaacataagaaacactactatcttttacttttgttctggccttgcatacacatcctccctgtctaacttattcagcccagcaagcagacgtggctgtgggaaatcaggctgcttggaccatgtgggagggagctggacttcatgcccaagagcacatgggaaggtctccttgcttggctgaccaccagggcttccatcacctctgtgttccatagttcttcactttcatttgataacttgattaaataaagcagccacgcacctctgaatggcagcaccatacctactttaatttttcaagaattttgacctattatatgttaaattcttaaatgtaattagaatttgggttcatttgtgagatccatgctaattgatcttttttgaccttttattattgttattattattattactattttactttttgacaatagtggcttgcctgttggataactttcatttttctgctgtttggtattttgtactctggtgattttgaaagatgtgccccttcatttcttcacagaagaatgctttaaaaaatgatcatatgaaagagtccttcctctggtttcgtaactgtggggaagatccctccacaccacagcactctcatagactcacacacacagttcagctcttcttccactcagtttatccaagggaaactaagctacgcagaggtgcctggagataaagacttgacctatcctagctctcatgccatgagaattggtactgcacgtgtgacttctaacctgtgtttgaacacataacttaatgaaaaagtaaagtaaatgttctaacatctgtttctccttcgtacaatgcatctattgcatctcttctcctttctacgttgaatatggattactgtgggggattttatcttctaaaacactataaacctttagccagggactgggaaaaacacaccctctgtctaaggagtgttctcagagaaacagcctttggaaaagctgttaagcaggaaaggtttacaagagaaaactattcagtcacagataaggtaattaggtcccaattgtatcattaacaatacacttcatgctagaaagtttatataatagttcatttttaagtaaaatataataaccattcctattcttccttcattgtatttattttttaaagctgatttctatacacagttctttcactagccagtctgatcccacaacttaataaaaacttctcactacaaaaatattcagaaacatccatataatccattaatttatgatcatttttgattatttaaaagacatgtcattaaaagtcaaactactagtgttaacataaaataaaaatgatacaattttcaatatgattaaagaaatacaagggaataaagaagcagaaaccaatggcagcccaggtgttgttataactttttagtgctttatgagacaccacagattagttgtatctttattttcccttacagttatcctagagttcattgatcatttgtcaatttacacactcctttagactgaagtttgattttcctttagaactgcctttattcttttccgttcatacactaggaaattgttgagactataattgttttatttctaaagaccaatacttggctttggtacatttattaattcagtaacttcttagtgagcatgttctaatcatgagattcagacaaatcctcctagactctacatccttttgagatattctccttttgaccaacgctggcagagtcctgaaaacactgttggatttattactggatcaaggagctgacagagctgccattgtttcccctcagcataatcctcctctgaaatgctactatttggctgaagccctcaggtggagtgctgcctgcaagagtcaggcacaagtgatgtccatcctggaatgggagtttgcccctaacaaatatgaagactccttgagctaagagagagaaaatagagaccaacattcagtaccagatgccataaaatgatgactgcacagtcaagtgaagggttaagtagaagcataatcaatagaatgaagtgcaagactgaagaaattgagaagaacagtgtgtccacacttagtgaagcaggtgctcagtgcttatgtccaaaaattctgagaatctgggcatccatcagggttgtccagaactgtgagggctctaagatcctaccctacatccaagctgacaagttaaactgtcacagttgcatggatggtagcagaagacacaagattcctgggacagaaaccaaagactttattagctagatgcagaggctcacacctgtaatcccagcattttgggaggccgaggcctgtggatcacttgagagcccaggagttcaagaccagactggacaccatggcgaaaccccgcctctgcacaaaaatacaaaaattagctgggtgtgatggcacatgtctgtgatttcagctacttgggaggttggggtgggagggtcacttgagcccaggaggcggaggttgcatcgagtccagattacatgagtgcaccccagcctggatgacagcgacagaccctgtctcaaaaaaacaaaaacaagactttattattcatagcgcagcaagcagctaagcattcgcctatttgcatcaatgtccttggccatcaagtcccacagggcaacacagatgggcacatgcagcaggttgccttacaggagaaaaatccacatctattttatggacattaagccactctgcactctgctccaaagagacattctcactgttttgcaaggctgttagcaaacctcctcttttctctgcaaggaaataacatctctctcttcgaaggctttttgctatggaaacatccgtgaagagagttcagaacagagctacgagtggctctgtcatacaatgcacagaagaatgagaggctcacaaagaacagtctgtcataggggcattcttcattcccttctaatcttttgtataacaggcatcacattttcaaaatatttagtgaataatcattctttctaaatcacttttttcctgacggtatttccactggggaccagggaaaggccactgggcagaggcatgggacagcatcagaggaaggagaaggtggctaatgtcgcttcagaaagagggaagatatggcccagaggatgtatcagaggcacaggcagagcgaggggaactgatctctgaaagattcccaggggatgaaggaagaaaggagtcaacagataaggaaagtaggtgacaagacgctggtgtcccaacctctctggagcctcaggatagaggggatggggcaaaggaagttggaagcagatgccattttccttacttcctgactgaggtttataatttgggttctctagaagcagatgctgagatggaatttgggatgcaagatatttattagagatcaacaactgtggaagagtcaaggagaagcagaactggacagagagatgttgaacttcagaacaggaccagcaaggcatcagccaacctcacagggaaccgagatgtagatggcatgttggcatcttccgggattgagccaaactagccaggcagttattcccctgctgcactcaaccaatggatgtccattgtcctaagagaggtgggctcttaggtgtggcagctctggagctgaggcacactgggcaggggctgacaactgggagctaggattgtctgctgaccacattcccagctgctgtggcaacaagttcttccttgaatggggaactagaaaggtccctgctgcattccccacagtctacccctgtgtcccttgggtcctcttttccctgtaagtttgttaagcagtgactccaggatcctggagagcccttttcctttttttcttttttctttactattatactttaagttgtagggtacatgtgcacaacatgcaggtttgttacatatgtatacatgtgccatgttggtgtgctgcaccagttaactcatcgtttactttacgtatgtctcctaatgctatccctcccctctccccccaccccagaacaggccccagtgtgtgacgttccccttcctgtgtccaagtgttctcattgttcaattcccacctatgagtgagaacatgcagtgtttggttttctgtccttgtgatagtttgctcagaatgatggtttccagcttcatccatgtccctacaaaggacatgaactcatccttttttatggctgcatagtattccatggtgtatacgtgccacattttcctaatccagtctaccactgatggacattcgggttggttccaagtctttgctattgtgaatagtgctgcaataaacgtacatgtgtatgtgtctttatagcagcatgatttataatcctttgggtaaatgcccagtaatgggatggctgggtcaaatggtattcctagttctagatccttgaggaattgccacactgtcttccacaatggttgaactagtttacagtcccaccaacagtgtaaaagcattcctatttctccatgtcctctccagcacctgttgtttcctttttaatgattgccattctaactggtgtgagatggtatctcattgtggttttgatttgcatttctctgatggccagtgatgacgagcattttttcaatgtgtctgctggctgcataaatgtcttcttttgagaagtgtctgttcatatcctttgcccatttttgatggggttgtttgattttttcttgtaaatttgtttaagttctttgtagattctggatattagccctttttcagatgggtagattgcaaaaattttctcccattctgtaggctgcctgttcactctgatggtagtttcttttgctgtgcagaagctctttagtttagttagatcccacttgtctattttggcttttgttgccattgattttggtgctttagtcatcaagtccttgcccatgcctatgtcctgaatggtaatgcctaggttttcttctagggttttcatggttttaggtctaacatttaagtctttaatccattttgaattaatttttgtataaagtgtaaggaagggatccagtttcagctttctacatatggctagccagttttcccagcaccatttattaaacagggaatcctttccccatttcctgtttttggcaggtttgtcaaagaccagatggttgtagatgtgtggtattatttccgagggctctattctgttccattggtctatatctctgttttggtaccagtaccttgctgttttggttactgtagccttataatatagtttgaagtcaggtagcgtgatgcctccagctttgttcttttggcttaggattgtcttggcaatgcaggctcttttatggttccatatgaactttaaggtagttttttccaattctgtgaagaaagtcattggtaggttgatggggatggcattgaatctataaattaccttgggcagtatggccattttcacaatattgattcttcctatccatgagcatggaatgttcttccatttgtttgtgtcctcttttatttcattgagcagtggtttgtagttcttgaagaggtccttcacatcccttgtacgttcgattcctaggtattttattctctttgaagcaattgtgaatgggagttcactcatgatttggctctctgtttgtctgttattagtgtataggaatgcttgcgatttttgcacattgattttgtatcctgagaccttgctaaagttgcttatcagcttaaggagattttgggctgagacgatggggttttctagatatacaatcatgtcacctgcaaacagggacaatgtgacttcctctttcctaattgaataccgtttatttctttctcttgcctgattgccctggccagaacttccaacactatgttgaataagagtggtgagagagggcatccctgttttatgccagttttcaaagggaatgcttccagtttttgattcagtatgatattggctgtgggtttgtcataaatagctgttattattttgagatacttcccatcagtacctagtttattgagagtttttagcacgaagcgctgttgaattttgtcgaggaccttttctgcatctattgagataatcatgtggtttttgtctttgattctgtttatatgatggattacgtttattgatttgcgtatgttgaaccagccttgcatcccagggatgaagccaactcgatcatggtggataagctttttgatgtgctgctggattcggtttgccagtattttattgaggatttttgcatcaatgttcatcagggatattggtctaaaattctctttttttattgtgtctctgcagggctttggtatcaggatgatgttggcctcataaaatgaattagggaggattttctctttttctattgattggaacagttcagaaggaatggtaccagctcctctttgtatctctggtagaattcggctgtgaatccatgtggtcctggactttttttggttggtaggctattaattattgcctcaatttcagaacctgttactgttctattcagggattcaaattcttcctggtttagtcttgggagagtgcatgtgtccaggaatttatccatttcttctagattttctagtttatttgcgtagaggtgtttatagtattctctgatggtagtttgtatttctgtgggatcagtggtgatatcccctttatcattttttattgtgtccatttgattcttctctcttcttatcagtcttggtagcggtctatcaattttgttgatcttttcaaaaaaccagctcctagattcattgatttttttgaagggttttttatgtctctatctccttcagttctgctctgatcttaattatttcttgccttctgatagcttttgaatgtatttgctcttgcttctctagttcttttaattgtgatgttagggtgtcaattttagatctttcctgctttatttagtgctataaatttccctctacacactgctttaaatgtgttccagagattctggtatgttgtgtctttgttctcataggtttcaaagaacatctttatttctgccttcattttgttatttacccagtagtcattgaggagcagtttgtctagtttccatgtcattgagcggttttgagtgagtttcttaatcctgagttctaatttgattgcactgtggtctgagagacagtttgttataatttctgttattttacatttgctgaggagtgctttacttctaactatgtggtcagttttggaataagtgtgatatggtgctgagaagaatgtatattctgttgatttagggtggagagttctgtagatgtctattaggtccacttggtgcagagctgagttcaattcctggatatccttgttaactttttgtctcgttgatctctctaatgttgacaatggggtgttaaagtctgccattattattgtgtgggagtctaagtctctttgtaggtctctaaggacttgctttatgaaactgggtgcccttgtattgggtgcatatatatttaggttagctcttcttgttgaattgatccctctaccattatgtaatggccttttttgtctcttttgatcttttttggttgaaagtctgttttatcagagactaggattacaacccctactttttttgcttgccatttcttggcagatcttcctccatccctttattttgagcctatatgtgtctctgcatgtgagatcgctctcctgaatacagcacactaatgggtcttgactctttatccaatttgccagtctgtgtcttttaattggagcatttagcccatttacatttaaggttaatattgttatgtgtgaatctggtctgtcattatgatgttatctggttattttgctcattagttgatgcagtttcttcctagcattgatggtctttacaatttggcatgtttttgcagtgactggtaccggttgttcctttccatgtttagtgcctccttcaggagctattgtaaggcaggattggtggtgacaaaatctctcagcatttgtttgtctgtaatggattttatttctccttcacttatgaagtttagtttggctggatatgaaattctgggttgaaaattgttttctttaagaatgttgaatattggtccccactgtcttctggcttgtagagtttctgctgagagatccgctgttagtctgatgggcttccctttgtgggtaacccgagctttctgtctggctgcccttaacattttttccttcatttcatctttggtgaatctgacaattgtgtgtcttggagttgggagagccctttttctttagggaaatgtgcggaagaaggttggaaggaaaaactacaggcctcatccccacagctggcctcaaggccacagctggtatgaatcgtcctccttttccattgtctgttctagactccccttacctcagcctccacccctgctgggcattgtggtttgcccagtggcatgagctgcatcctcatccttgaaggctctgaccccctggtcatgattcccttctccagaaagtgtgcactctcccactggctgaaaacattgtgtaggagcatgccagtgggggtctgtgttcctccctgtccatgctgtctaacaccagccctacccctcctaaggagcagatgcaattccctctgccaagatggggagttgtcttcttacctgtttgtctttgaacacaaggagtccaaagtgtcccagcagcagccagagcatgtaatgcgatagaacccttgctgggtcccctgattgaagggagcctcctctggggacttgggactttaactttgctgagcccaggattagggtgaccagcaccataaatcctctcagttgtttgttcagaagcatgacaattgagatcacacacaaccttcctttcccaggcccaggtattcttcctgtgtgagatgcagtaccctccaaaggtgcttggttggatgtgcacagtgcctcggacgatagtgctgcattctcggatagcatctcccccaagccggagctctgactgtaccttacacagggtgttccaaccctccattcagctggtgaattccaggtggagccttacgtggcacgaccagtgaatcccatggttgccacagtgggcctctgtacagtacccctcatctgacagatgtggtgtggaggctgtgttagtctgttctcacattgttataaagaactacctaaaactgggtaatttataaagaaaagaggcttaattgactcacaggtctgcaggctttacaggaagcatggctgtggaggaatcaggaaacttacaatcatgacgtaaggcaaatgggaagcaggcatatcttacatggcaagagcaggaggaaagacaggggaggtgctacacacttttaaacggacagatctcaggagaactcactcactctaatgagaacagcaaaggggaagtccaccccatgatgcactcacctcccaccatgcccctccttcaacattggggattataattcgacatgagattcgggtagggacacaaatccaaaccatatcaggctaagctggtgatcatgcactatgtgtgctgcctgacaccctgcaggccatgcacctgaggccaggctaccttgtctgaaatagcagctgcagctgtggctaagacatgattgagttcactgacatccttcaggatccatgtgggatttttttggggagtcagtctggcaaattgaatgtggatacagtggatccttatccttaagttctcccgtagcctgcctggtggtggtatcactggccagggagacattttcagaggcttgtacgggattgtcccaactgtgatagtcctcatcctgcaggacaaggacccaaggtgggattctgcaaactagtaaacacatcaatcccagttatacatctggggactggggaaaggccactgggcagaggcatggcacacaatgagaagatgaggctgctgggtacccctgtgctaatgtggttgccagagactgagactggacaagcaatcccaagaaaggaagggaccagaactcccgagttactcccaggcgatgttggaaatgatgggcagactcaatgggcttccctgcttccctgaagggagataagcctgaagccataaggtttcccagcctgcaactccacgcaggacattataggtcctcaaggaggctggggacctagcaagggtcactatgggatacatcatcatgcaaggcctggctccagcactgccagaggctgaatcaggaactgccagtcacaggtttcagtggatgcccatcacccatggggacaagggacgccactgtagacaggagatagtgccaagacctatgccccccacccatcaccaaacactgccagcctcatagccaccacctcactcaccacatcatcgtctgggaatttaacaagggcaagaggaggaaacctcaaagcagatgaatttcagttcttcaacaaacattcactgagtgtgttaggcaccattttaggtgcctaccctgggcaacctaaagacgctgttcaaatggtaagatcacactgaggatgacaaatctgattgcaattatctctccttctatccaaaattttaagaacgtatgagaaagacagattgtctacaaataaaataatgaggttttgcttttttgttgttttttttacatatttgagtgtcagtgtgggtaactgtgtgaccacccacccctaactccactttaaaaaaaagttatgtatatatattagagatgggatctctctatgttgcccaggctggtctcaaacttctgggctcaagtgatcctcctgtctcagcctcccaaattgctgggattacagaaatgagccaacacagctttttgtatcttcattcaccgtggacaagtacatgctatattttaattacgtgtccacttggatatacgagtggtgatcaaaatagacaccatcactactgtcagtctacagagagtgtggaggaaatataacattaaatcaccaattgcagaattagaaatggagagaagtagtgtgcgtaaaagtcacagtgctgagactgaggataatgttggggacagtgcagggtgggaccattccagaaaagatctggctgcggaggaaggaggctgcgacttggagaatgcagaggagcccgttctgggaagagtgataaacatacagctctccaaggagaacacactaaggcagacacgagggaggctttttggaaaattcttacattttcttacagaagatgaaaacgtagacattattagcatttcatgatataatcttccaggccccctccctcgctccacacgcacacattttgtttaaaattattcggtggatactgttttgtgttgttacattttcttctacattatgttaatggctgtggcaatacttgtatgaatatgctatgattgatacaaactcctatttttggatatttaaatcacctctactcttttgctattataaatagctccctacagaacattctcatttccttcaaataaatttctaaacgtgaattggctgatgcaaggagaatccaacattggctttgaaacctagtatttaatataaaattgtaaaattcctcctacttgaacgctggcatgtttcatcatattgtgatattgtgggatatatataaatatatatttgtatatatatttatacatttatatattatatatgtatatatatttatatatataatatatatttatatattatatatttatatatagtgtatatatttatatattatatatttatatatagtgtatatatttatatattatatatttatatatagtgtatatattatatataatatatggtgtatatattatatataatagtgtatatattatatataatagtgtatatattatatataatatatagtgtatatataatatatatttatataatatatatttatgtatttatatatatatttatatatttatatatatttatatatatttatatatttatatatatttatatttatatatttatatttttatatatatttatatttatatatttatatatttatatatattatatatttttatatatttatatatattatatatatttttatatatttatatatgtatatatattatatatatttatatatatttatatatgatatatattatatatatttatatatatttatatatatatatttttatatatttatatattatatatatttatatatatttatatatatttatatattatatatatttatatatatttatatattatatatatttatatatatatttgagacagaaatatatatatatataaaaatatgtatatatatgtgagacagagtcttgctctgttgcccacactcaagtgcagtggcatgatcttggcttactgaacctccacctccccaggcttgagtgattctcatgcctcagcctcccaagtagctgagaccacaggtgcccgccaccacaactggataaattttgtacttttggtacagactgtttcaccatgttggccaggctggtctcaaactcctaacctcgagtgatccacccacctcagcctcccaaagtgctgggatgacaagcgttaatcaccacgcccgaccaaaacttctatttagttgaataatttcaaattaagtatgtgcatgtagtaaataattctaatagctcaaaaaaggtaagtttccttcttgccttctgcccccagcactcccaggctcagtgtctccctcctggaggcaatttctggtatgtttctccataaatgttttatgtgtacacaaacatgtgcatgtgtgtgcatttttttacataaatcagatattttagaaatcaatatatatcttcatatttttacctaatgacctttttatatcagcccatacggatttatcaatttgtttttaatggggacagagtattccatttccatagctgtaccatcattcatttagcccatctcttattattgaatatttaaggtgttcctgttttgccttttaaatatttttatttagatatattttacatacaatgaaatactcagatctgagggttcctgttcatggagttttacaaatttcacacacatggaacccacactcttgtcaagacacagaccattttcatcatcccagaaagttcctactcatttcccaaaaattgtcactattctgatttctttcaccacagattagttttacctgttctagcatgtcaaatatacggaaacacagagaatgtaatttttttttggtccggctttattcagtacaatgttgggttttcctgtgggattcatctgtgtcatctaattaacatacttttatttaatgataagcgatgtcttattatttgagtatacagccatttgttatccattctcttatcattggatatttgcattgtttctacgtttgtgctactgagtcaagcttctacaaacatcttttcatatatctcgttgtgaccatgtatttcattgcttttgggagtgcaatggttggatcacagagtaggtgtgtgttcgacctgttaagcagctaccaaaccactttccacagtggctataccctttgatgctcttgccaggcgtgcatgagcatttgggggaatcaacagtctcacagtcattcactgttaatggtcttttcaactttagctactttagtggttgtggagttgtatctcattatggtttgaatgtgcatttgctaataactaatgaggacacaacattccaagaagaaataataacatttttgaagaccctaaagcaaaaaaggagtgttttttgaaatttcttatatgtgattgtatagaaaatatgtatataaatattattagcatttcagattatatctttctagatctttctctctccacacacacacacatttatttagtataattttttaatgtttttctagtaatatgttatatgaataaccataactggtgcagccaaatccctaatttttgatatttcctagtgcctttgtccttttactctttgctctgaaatttgtttgggtagaactagagtagcccatctcctaaaatgtggtctctcttgggttgtgattaaatgccctggatattctgggaggtatcttctctctggctggctggaatttccgtcttccagcaccctgtggtgccagcatcccctgcagcttacaacttcccagagctgtgcttttccaggccccagggattccaccctacctacacatgcacagcttagcacttggctaaagacttgagaaaaccctgcacatttttttttttgtctcttcactgcacagctttctcctctccagcgtgctgcactagaattccagccactccagaagcctccaatcctgcctcacttgggctccacattcctgcctcttggtccacaaagggcctatagcagaacaccgggaggattatggggcaaactgtgtgcatttctcttctctccaggaacacaatcctctgcttcttgtctgacacctgaaaatagttgcttcctatattttgtgtagttttgtagttacttacaccaagggggctagtctggtaccagttactttatcacattcaaaagttatcttcttgtttttttgtaaaatgaatttgtcataaaaagtaaatcttcagtggacatacatatagctctatagctgtatctctacagacacctcaaataattttctttatctattgaaagtaataatgctgagtcaagatgtacagtttttgaaatttgtctcctatttgtgctagtctttcagttataccctggcttgcttcaacagtaaataggcaatttttaataattactttctaattataatgaaaataaatacatgtaaactgtacattttttcccaaggagtaaagcagaactataatgaaacagaaatttttcttctggatcaatactcatcatctttagaaagaaaaaaaattaatagttttcttctgtatgtttcaaaattttctagttctaaacattcaaatgtgcagtttttctgcttttttttcatacaaatggaaatatatttttgcattcttgtgcaatttttaaaaagtaacaaaatatactgaataaatttttatattagcacaaatgtagctatcacattttaaaaaaacctataaattattctttctacatgcaccataatttaattaataagtttcccattgatatggtttggttgtgtccccactgaaatctcatattgaattcccatttgttgtgggagggacccagcatgaggtaattgaatcatggggtcaggtctttcccaactgttctcatgatagtgaataagtctcacaagatctgatggttttaaaaacgggagtttccctgcacaagctctcattctttcttgccgccaccatgtaagaagtgccttttaccttctgccatgattgtgagacctccccagccacgtggaactgtaagtccattacacctattgttcttcccactcttgggcatgtctttgtcagcagcatgaaaacagattagtacacctattgatggacatttatgctgttttcagtttctttcagtattttaaataatgctacaaggaaaattcggtgcaggccttcatgtagacatagtaatatacctgtaaggtaaatttcccaaagtaaaattggaagaccaaagtaaatatgcattgcattttgacagacattggaaaaatgctctccaaagagattccaccaacttacactcacaccaacagcaaatgagaccatctgttggcccacatcctgtgcacagtgtgaaagatcaactttccaatctttgccaatctgataggttttaaaaaatagcatctcatttcgatttgtgatttaattatgcatgagattatgcttctttctttttcttcatattggtgtatgtttgaactgcttattcgtatcctttaaataataaactgtagtggggtcaagctgggcctggtagctactgctgatgctattgaattatggtgagttaatctaagcaagaagctcatgggccatgtaattcaccccaagaaatgtttctgaagttgtacgggtttttttggcattgattacaggtttaacgacttttactctcaaaatgcttaattcacattacatatgtgtgtatgtttgattacaccaatgtttctgcatactactgcaaaatactctttaaaatctggggtcacatcctgtttcacagatctgataatgagtaaagccaaactcttagctcatgtttgggtatctggcctccattaagctgctgtctctattaccacatagtccattcaacattctctcaatgtcttggaggtgttagggcagaggctggcactgtacgtattaataagatgtccggcttagtgacaggaggtcttgtttattataatgaacaaatgaaggtgtttcaagtatatttatgtggctgcttaagagccaacctccactgctgtgagacttagtaagaggtggctaccaaggacctgctcctgcaagcctgttcccaggctcccccaagcatggctctgggacacggtgagagctttctgtgagcttgtgtgagactcagtcccagacagaggctgcctcccacttctcagctgaatcctgggctttggaaaccctattgtgtgccaatataatcaacctacacatgatgtcacaagacagagaaaacactataaatggtatccaagttcatggcactgagtctccaagggctgtgagagaaaaggttggtaatgctggcatgattgcttggctgaaagaagggccatggcaggaaagatgtaactgaactgaagatgcagccactgcttcaacgtaagacctcacctcgttaatttgggtgatcagaaaagcagacattacctcctcctgtcaatcgccttattttggtgaattcttaaatagcctcttagccactgttgtgactcaataattgtgaccttctaacagttaccatggaaagaattcctagattataaataatgacaatgtgagtttcctagttaccaagtgtatttataaaatgaattccaaaggtacatgacatttaattccagcctatttttagacactaaaggataataaaggaaaatactttttttccagaagaggaagaattgtaacatttttccaaatctagttatagagcagcacatctatatgactataaggaaaaaaaggggggttttagtaatatactgtccttggcaatttaaagggagcatttacaataatacagatttcacaattaaatggagtctccaaaatcatgtatagaatttgatctatacaaattatcttggaaataaaaagatatagtgtcctttaataattttttaaacacataaattgggaagacttttatgccttctactttacaaagtatttcttattaaaggaaatcattatgtttcataaagaactctttcttattttttttaatagacatgatagggtcttgctgtgttggcaaggttagtcttgaactcctggtctcaagcgatcctcccatcttggcctcccaaagtgctggaattacaggactgagccactgtccctggcccttcataaagaactctcggaagcacaagtttacctagtcaaagagttacaatccaagaaagaggagtgaagattctgaaggaatacattacaaaaaagaaaagctactaaatggtgtctaaatcacattttagtgtgctgcagaaatgacagttcaaaaaaaattagagcaatggaaatacaataatttttatgtcctgtctagtattttgtcttttccaaacactgttccaggagatacttcaaagaagttgatgtataatgtttcttagacttgcatgcaatggtctcataattgaaacattttcttctttctgaatcttgaatcaaatcctatctcttgtccatactctgaaacatgaaatttgagaatggctatggtccctttctccatcttgaaagccagcaacagcaaatggagtcctcctcacattgcttaattcacattctgtgatcacatcaccgtgacctcttccatcccaagtctcccccagactctcacctcctgccttcttctccctccgatgatgacccttgtggtgaccttggttccacctggataaccgaggatactctctccatctcaagatctttagcttttaacttaatcacatcagtaaaatccatttgccactaaggtagaacatacacaagttctggagatcaggatgtggacctctttggagagggggaccattattctgcctgccacaagcatttgtttattctctcaaaaatatttcttgaatatctactatattcttgatacagtgctgaacagatgattagaaggagaatggagggttaccagggtat

SEQ ID NO: 1468 - DNA, 1611 bp, Homo sapiens
ttgatatagttgagaggatccagaacaaggcaccaaaatgatcaaaggaatgacttgtgcattaagatcaaaagacctggcagtgcaggtcaagaattggtggagaggggatacctggtacttgataagagtctacaaatatttaaaaggtgttaacagggaggaaggcaagcccaattttgcctgcttggaggtgacataatgtgaaacagtaaaggtaacaccaaagaatgaacaatgtagccagaagatcaggatctatttccagcaaagaactactgaggtttctgcaaaattacacaatgtgaagcattagatccactgtacccctagcagaaagtaaccttgaacaatttctatttgcagatcgctgtgtcttacgtctttcttgcctctattagcccatcattcagtacttaacaactcacctccttctacccgttacccaaattctttaacatctttaggggtcccatcaatgacagtatgcctactttttggaagaatatgatttatgtagcaaagctaagatagaaatttgcaaacagaagccgggcgtggtggcttacacctgtaatcccagcacttcgggaggctgaggcgggcagatcatgaggtcaggagatcgagaccatcctggctaagacagtgaaaccccgtctctactaaaaaatacaaaaaattagccgggtgtggtggcgggcgcctgtagtcccagctactcagaagcctgaggcagaagaatggcatgaacccagaggcagagcttgcagtgagccgagatcgtgcgactgcactccagcctggatgacagagcgagactccgtctcaaaaaaaaaagaaagaaatttgcaaacagaaaagcatttgaacagttgttgtcactttatgtgttccatatgcagcacatttgttaatccaggagtacagagtttagaatcatgaattttaagaaacagaggcaagcttgaggtgatccactctgatcagagaggctaggtgacttctacaaaatgcatgagccagagacttctgcaaaatgcacaaaacagagcagagactaaaacctaggttctcaccgaagtggggttgattattatcaggtagcattacctttctgttcctttagagacagtgtctcgctcagttgcccaggctgaagtgcagtggtgcaatcacagttcattgcagcctcaaactcctgggctcaagtgatcctcctacctcagcttacagaggaatcctttttcattttttaaaaaatgcagtagtttccatttctctttttttcctaaaagctatgacaaacaaattttaggactttttttttttccttggctggatttccaaagtctcacacttttattattgcttaggatggatttacttaaaattctaaactaggtttgttaatggtaaaggccttatagcaaggcctgagcaaaagtcaacccatctgttgcctttcatacaatgagatgcttgggctgagaggggaggctgctcccccacacaggaatgaacagctctgctcccctacacatgaatgaacagctctgctcaatacaaattctccagttagatcaagcctccgacggggcatgcctgaat

SEQ ID NO: 1469 - DNA, 3813 bp, Homo sapiens
tttacagtttcgttgttgacccccaaaaatcaaaactggagtcattccttataggaatgaatttttaaaaaatcagaactgaaagaagcagtacacttggcatgatgtgccaagtatttataaattttgtatcgattttgtaaaaaacttatattattttgtgactgtttcctctggtcttatatcctccaacaactccatgagtttattgtttgaaaggatgtgagggtttgggtaatcccaaatgctcataaaactctaggccctgaatgatgtattatgttgcttgtgacttcaaagaaaggaaaataataacagaccagggtctctggaaagtgaagggacagttataaatgtaacaaaccttgagatatgtgtatcaatcatggttctccagaatagagccaataggagatatatgtgtgtacatatacacttagagagagagagagaggcttattttcagaaattggctcacatgattgtgggggctggcaagtctgaaatctgtcaggcagcctggcagagtggaaattcaggcaggaattgctgttgcagtcttgagtctgaaatctacagggtaaggtggcaggctggaaactcaggcagggtttccacgttgcggcctagaggtgagggaggtggagttctgtacccaaagagtcactcagcaacctcttaaataattgttttcatttatagtctgcaaccaggcaattcaataccaaaggctcaggagatgcctgacagtaaaaggttgaagaacaatccagaactcagagaaatgcttaaagtgaaatgctccttcctggttctattactgcatatgtgttgacttaaataacttctgtttcttaatgattcgcattttcaaaggccaaacctccacattaaaaccagccaacacaaatcattatgaaactgttaggggataggctgattcctgtgctaaaactcatcaacagcatagaaagatgaaatgcttccccagtgattttacagacctgcagccaggtcgatgtcttctgtaagtagcgtctgctataattagtttggatcaactcagaacctctgtgtatacttatgatttgtataatagcacagaaagaaacttcagaataatctgtcttataaaaggatggaaaaatcctctgttaagtgtgagcaaattgagtccaggtcttccttactcaagggttggcacagagaagacagacctggtatcattcaaggatgcaatctgcctgggtaggttaaaaaaaaaaaaaggaagatggataagagagtttagggtttgggcaagagtgggatggtgatgctgcaccatgaaatctaaattgcagaggaagggagggaaatgaacagaggcagggctgtggatagggccaaaatggagtatgggtgagctggggtccttgctgacagttccaggttgaagcctgggaccatgtgccaggcagcagatgctccacaaaggtgggggccgtcaccacaaggtgggggagtaatggtctagaagagatttggaaggggggcaggacaataaccctcacctcctgacctggggaatcacaatgataattataatgatggaatattaatagctaccatttctggaggccttataagaagagagaatttggacccaggcacacacagtaggaagaccgtgagaagacacaggcagaagacggccatctataagccaaggaaaggtctcagaaagaagcaatcctgccaacacattgatcttggattttagcttccagaactgtgagaagacaaatttttgttgtttaaaccacccaatctgtggtactttgttatgtatattacaggtatagaagtgggatctgtacctgttttcgttttatatcatctgtaggagggaaggctttgctaagtaagcaactttgattagagtatccctccttttatattcctacaaattttctcaattttacatatgtgtttctctaccacctagttgatctgattattagtaggaggtgttagtatgaattaaaagacacattggctctggtactaaaagaatagaaaaacaaaaagagattctaaatactctcatagaatgtagaagtgggttgagattctaagaattttgctcttgactgcatgattttcaccatgtttcagaaatctggatgctaagaaggttatgagaaaactatgcgtataggaaaatggcaacaaccaaaagacttaaggaatgtaaggagtacgtatgagggcttatgtacattctcttacctgtaattaactatacagattaaactgcacacacgtttaatggcgttttcttttatttttaccagacattcatttactccttaaatagtttgcttttatttgcacacagcaaggtaaggtcaagcattagaccatcgttaagtactattttagcgcacacatatgcacataattccttctctctatggccatgtattcagaactgctaactggatacacacaggaaggaaggatttcaggattcccagtttgggtgacattttcttatgatctcctgatgaacttgaagccagacatattaagtcggcctgtcctcaagccacaagaacttgaaagaaccagatctgccaaacacatccaacacaccttggttggtgtaaaccattcagctgtcagtacatgtcctgtctggtttcttcttgtgaatccccagactccaggatttgcacgctctatttttttctataaagtctattccaaaatcactcagttaacatgctaaggcaaacccatctgtgttgggcttcctttgggttatgctttctttttgtccttgcagcccagcctcctgcctattcctcactccaatatcatcatccttccaatgcttggtcccactccccctcatcatcctccctcccaaaccagtacgctctatgctcctatacttcccactgtttacaaactcccctacaacctcagactcctctttgtagctcctcctggtctccccaatgtgactgtcactagctctcccctgagacatcctaaagacctcatgttaccttaattatgtctctgaagattctatctccaaatgaagttacattctgaggtactgggggtcaggacttaaacatacaaacttctgggaggacacagacttcagcctattatggtgcccttccaaaagcttctgaattttaagtcagtggagattttttgaaatcagttgagcttcaatcagtaaggtctcctggctattacagacaacttcacaacacattttatggaaatggacacacagataggaagggaaggtctctttagcaaccccattcttcttctgggaatgttgaatgcatcatcaacctagagaaagccattagtgggtgcctcactgagatgtctagtccctgtagaacaagcaccttctcaggcaaattctcagcacattctcaaattgcccaaagtgctatcacttgacaaaggtcaaggaaataacagcaaatcatgaataaatgaatccatcactggataccacctcttgggtcactcctgagctacttcttaaaagagtttccttacctgaggttttaatttctgtcactatgttaggttttaaccataaaaagaacctattttgtaattaatggtctacgaggctgggccttggagttgttcctgacctttgtttccagtggaggggagccacattaaggagagcccaccatcaaagacagacagcatcatggggatggaaataggcataaccaatatttaatcaatatttaaaccaatatttaatcaccacagtttaac

SEQ ID NO: 1470 - DNA, 1668 bp, Homo sapiens
catgaggacaaataaccaagtgagtctattcttctcccccttcgttattcattccaacaatgaagccagagagaggcatctataaaaatcattagcagtgggaattgtagtaggtgtaagacttccatcagccctttagccctcctctaaagtaatctattttttccaggagctgaaagagtttaacaatctagaaaggtcaattctctaaaatattctcaacaatatctggattgctagcattttgtgagaacaggagacacaaggtaattttgtgagaggaaaaaaatgccttgaatagcagaaaactcaaattagctttttatcccctccagaatagtagtttgagaatgtcagaaagcttgaccaaaatgtaaatgtatgaaacagaacataaagaaatctgaaatcataaaatgaccactcctaaaaagaaaaaacaaaaaaacaggttgagaaagagtggttggttttgtttctacaaaatagaacctttaatgctggtagcatattgcttttcaaatatttggttctaaaatatcataaagatgaaaagaggctgaattatcaaattaaagaacacaacattgaagatactcttcaggcaacagaaaccacatccgtatgccccatatggtcctctcctctcctcctcttccccatgctacctccactctctggcctcctctagcccccatgccggggtgcctggaagatgggccccagagagaacctaccttaaattgacttggccaccggcaaaactcccagtcagagggttgcactattcataattctcatgtactctccctagagccctaatgttattttccaacagagtgacttcaaataccctttatttcagctttgctgaagtcaggaattagttgcccctgaccattgctttactgagatgcctaagtgaaaggtggaagaaaattccctattattatttctcagagagtcctggaagtcacttcccggccaggaaaaaaaattcaagcacgagtaagataactttgccactgagtagctaaaggatgaatggcacggtctgggaaactttaaagtatccaggattccaggaagacctgttccttcccaagatgcttaaggatctgttccctgctccattggagacatgctgttggaatgtggaaaagcctctccacttccaagataggaacagactgtcattctcccagaaggtaacacaaccgtgagcagctggaaggtaatagctactccagaacagaatattccactcaagtttctgctttatctgggcccttggcagtcagcccaaacatgaaagaaatgtcactgtactggaccgaagcaaggacctccgtcaaaaaggattacggaaaaaaatgagctatgggggagagattgtgtacaggacttttggctgaatgagaaactaggcccattctgaaatgagagcagctgccattccacggaagccctcaggccttcatttattttaataggattttagtggaggcttgccttagtcttgggttggtttatcatttatgataacccatcctgcgccataaactcaaacacatcccttcagattcattgacatttgaggagcgtgattttatcctcccttcacttaacatacactttttgatggcttacaatgtgacaggcactatt

SEQ ID NO: 1471 - DNA, 2255 bp, Homo sapiens
gacctcaagaaactgttgtacgataacaccaaaaataacagtgctaacacccagagttattttttgttgaagatggagtgggctgtgtgcaaaactgtgttttaaactacaaagcggagagaggaaggaaatataaagttataggattaagacacctctgtggggagaaaaccatgtagaggtacctgctcaaactattcagaaaatgaactctggggagataatggaacttctctaaattaaaatgaaaaaggacatatctaaaatattactcaaatgtataaggatgatatacaataactttccatatatcaaactcttggcctcaaatgatccacctgccttggcctcctatagtgctgggattacaggtgtgagccattatacctggccttaaattgaactttcaaaatccctttttagtattttctctagaaaggtgcaagatcttttgttgttatttttgttttttgattgtttatgtttggctgccagaagacacagaaagttgctaccgacaaaagtaaagagcatcttacagagtttcagttctgctgatatgtcctgaaaaagcaactatggctttgtacccttattaccatgtacaaatgcactgtccaaaaaggagttttggattcttttgcatagtgacttcaagggtaaacctttacataacttcattatgaggttgcgcgaaattatagcttagggtttctgcttatagtctttgcacatcttatctatatgctactggggcttatagagagaaaagtaatcctatgactatgtcaagatcagtgttgctattcctgttggggatcatgttaccatagtaatatattccctgaggcttagaaaagacttattttgcttaagtgctatttttattttattcaaaatgaagtagagataaaatcataaaaaggtttttctgttgcccttagatttaatgccgatttcaagcagaaggataaagagtaatcaatgcatatctgtttagcaactttcttttatctatgtgctggcttctcaggccagcgttatgatgtgaatgatgaggagaatggaaattagtttctgtgtttattttattttcccttttgatttgtggtttttctgcaaaggaggaggatcaactccactcctcaaaatttggaatgaatttcaagactgatgatgccaggcatatgtaaagaaagtctagagatttactactctcttaataacgccttctctagagagcaggatgggctcccaggaaggttcaaatgtggcttgacagatcaggaggagagggactgacttaggcttttataggagttaaagtccttggtctaggtgaggggtcttgcacaagagtgtgggtttgcttggtttgagcttcccaccagtgctgaaaaagggagtgtgtgtgggctttcctaatggcttgtctagatgtgaggtgagagaggaaaaggagtggggcttgaaagctgttagaggtcagatatcgaaaatagaccactcaccattttttaataacacctttattatcgaagcagattgtaaagacatgagtgaaatttttgtatacaaatatacatacaaatatgtacaggtgtgtttatgtatacatgtgaattcagatatcaataaaataaaatgacaacttttactcgctagaggtcccatgcatcattggaatggttactatggagctgtcctgggatactcttctatagcaatagtgaagacaggtgaggaataacctaattttgagcagcacgtcctcctttcctactctttttcctgcccctccttcctttttcttagtggaatttgtggatgggaggtaatgatattctttagttcatggaatattatcagtatagaaaagttaagcctcctcacttgttctatttcattattattttcttttttctataaaactcactgcacaaggcgtttctcttcttcctatagaaactcagttgattgtaaatacatgtgtgtggtagaaaaaaatgtatttttctgtgtgcatattatgagtttacacaaataatattttgctatagataatgcatattttactcaatattacacattaaaatttatccatgtagctatatgcagattgtttaatatgtcagactgctgcataacatccaaatatatgctttcggaacattgtagatatccgatcccttagtgatagatggctagaaatctgttctgtatcctgtgctctttctataatgtcctgaactacc

SEQ ID NO: 1472 - DNA, 3096 bp, Homo sapiens
ggcttatcagtgcttgcagtgtttttctttacagagttctggccaccctcagaaatgtcacaagtgttcagttaagtgacccccacacatactatatgttcagtaaataatatgtcccttctctctagaaagactttatagctgttaggaatatggcccttggcaacaacattttggctttgctatttataaactaggcacccttgtgcaaactgttaataatctagaactctttcctaacaggtttgttgtaataaatttacttaatataaataaaacaaagcccaggctataataagtgctcaataaaaggtaggtaatatttttctatgccatggctcctcgcattgatgaattgccccaggctgggctcaggctacattattgcaccatttgtcttcatgtattgtagttgatttgtatttgtctgcccatacacactggactatgaatctcgtagtgcaggagctatttcttgctcatttctgtattcccagcacatagcatggggattggcacctagttggtattaaagaaatgaacgtcacatagcatatttggcacgcagagcattggacccatggtcaacgtacagcagtgacaagaggatgtaccaaccctttttcttcccagctgcaggccttctttctcttagtcttagtcttatgaacctgcagagtccccttcaaccgcaaagcttgggcatagtatttcttgacacatggaagcttgccccagatattacagatcagaactatgggggtggcactatggaatctgaagtttaacatagaccccggatgagtatgaagcccatggaagactgagacccaccaagttggggaaacagccactgggttgtcctgcatgcagcaagcagagatcagcaggctgcaggcagcctccgaaacagaaaggcagagtttcctttccaacttctataagaacaagaaagcagtgattctcacacctgcaagacaaagggtggtgccaccaggtctcaacagatgacacctgcgtgtagagataatcacaggatgagccacgtcctccaacacaagataacagaacactctttctcaaactccatcaattctattacaccaataacccatccagaacccaattcaacctttctgaacccaggccagaggcctaaattccttgccagtcacttagggaggaggcaggacccagcatttactatgccctactaggtggcatgctttgtactaggccatcgttaaatggcaaagcatgcacaagaaggatga[450 bp omitted]cagagatgtccagcaaaacatctgttcagcaaaacatctggacagcaggcacccatcagggcccatagacaaaaagtttatataaatcctttaatctgaactcttactcagggcacaaacagccttttgctctatgcaccaaacagcccactcaagggcagagtgtccagggcccaaggcagtactgggccaacagcacaagcctgagcttgcctttctaggggtgcttgtcatcccaagcaccatctaccctacagagagggctcatcatggccacaaagcccaagctctctgtcttccagtgcaagaaggtgacatgaaaccagtggaaatctggaaggatccagttgaatccatagctctagggacaatggtgggatgtggtcattgagaggggcagttttgtcaatgtcaattcctcaagggttggcactcaagttagggaaatgcccagcttttctcttttttagcagaatggttttgagccacttattgtcattctccctttcaagagagggctagaaaaggaaaatgaggccgggcgtgatggctcacacctgtaatcccagcactttcggaggccaaggcgggtggatcacgaggtcaggagatcgagaccatcctggctaacatggtgaaaccccgtctctactaaaaatacaaaaaaatagccgggtgtggtggcgggcgcctgtagtcccagctactcgggaggctgagaagggagaatggcgtgaacccgggaggtggagcttgcagtgagccacgatggcgtcattgcactccagcctgggcgacagagcgagactctgtctcaaataaaaaaaaaaaataaagaaaaggaaaatgaatccttttgagcctccatcaactaaccttgaaaaaggatgggaaggaaagattaacatggacaaatgaggcatgggttttgtgaatccacacttcctctaatgggtgctttttgggaatgaaggctaacagcagagaagggttcctttctgcttcctccactaagtgactcctttagaagcttccatgatggcacaactctggcttaggtgtccctcgttgatgttcctatagcaccctttcatgatctgtattataatgattatctgattgtctcccactaaagacttcagtccatgagggaaagaactgtgtattgttttgtcatttgccccatgtctggaatatagtttaaaaagcaataaatatttgttggatgaagacttgaataaagataatgaccaatatataaacaaatacagaaccagaatgcttgcacattgtaccctattcagggctttattttaaacaccttatacccaattacaaacaactgtgagaggtaaacagataatagtgttgt

SEQ ID NO: 1473 - DNA, 2315 bp, Homo sapiens
caaagccatggccccagaagcaaggagagctcatcctaggtttagataggaacttaaataaggaaaaaaccttcctcaggtgctccaagaatcaaataaacacatgttcacagtggcatttccatggagatgttagaaagccaatctgagcgtgctattccatgtaatttgaacaggtgcaagttaagcatggtggcttgcattcctataatgccaataaaagctttaatactctggagattaattaatgataaaaacaagatcttgctggcatctgtgatgaatgcttgtgggtattgaatacatagcctgacacaggtatgtgtgtctgtatatgtgcattgagtttaagcattgtccaaaagatggcactgtttgtgtttttatcatgtttaattgcaaactttatactatctaggcatattaatgaactaatttaagacagagcagagatatcatcctccacacaaatcaaactgctactttattataggccctttcaaactcttcatctctttcctcacgaaatgaatatgcccaagctgttaaatgcaataactgcaatgtcagcaaaccttttatttatcaaatacttttttttctatcttaaaggggattataaaacctacctttgaaatcattacagatacacgacagaagacggataattgtgacatatttaactttttaatcttgggaagctagatttttcaaatataagtacttcttgatcatttaaacgtgactacacatgtaacacacaactggtagttgcagtaattattaaaaagcattgttctttgaaattactaacacagcaaaaggtgaaatctccaaataactttatgagggcaaataggaaattagctccaataacattctacaatctcaaaatgtactagggaatacttctgtgtgggagtgagacatgctgagagatggcttgttagaagcactctgatgttgcagtggacatatacatttttgcctgtacagcatgtcttttggaaatcaccgttcctcattcttaagcgacttgcagtcattgttcattggccaaagcaagtcaaatggcaaccctaaattcaatgggttgtggaagtgcaggactgctatgttcctgaaagggtggggggaaagtgaagtatttagataatgtgtactattacctaaattcagggtgtggttttcataaggctagaagcaaaagccagtgagtggtttcgccaagttggcggagaaggggtttgttagatacggagataaataaaattccataaaaaaagctttccctaatgacaaagaatcatcagggagaaatgacacagaatttgcattaatgtacatactagagtggattagaatgttttttcactccaactcctacagagtcacttatagccaaggctagattagagctttatagagcagaaaacattttccctttatgcaaaaaattttcagggaactaatgttctttttgataccagcagaaagcaaacagtgttaagatacttttattatggtaggtagcgtttgaaatatgttcccagcaatgtaaaagagcagcaagtgagtagcctgctaagagtcctgtagcaattaggaacttccagagaacgaataaagatttctcttatgcatatttaataacagctgaaattttatggtagagagtgccaggaattttgtgtctatgtgtttgtttttctttatttcttgcttcctattgcatcctctaatatcttattagtttgtaacattctcttagtggcttcagtataataacttgtattggaattatctgttcatattttatgtttcctgaagaactgggtataaggagacaaagataagattcattgacatagggaagttgcttagatgcagaaaaagcgctgaaaaaaactaagacactagctgggatagatttgtttcctgttagtagctgtgcatgaatgcatcaatgttgttgaacatttgttttccctgatactgtgtatcaaatgagaactgttcagtgacttctataatgcattttaggtgatcttggggctgggtgcagtggtgcatgcctgtaatcctagcattgggaggattgcttgagatcaggagttcaagaccagcctgggcaaaatagtgagaccctgtttcctcaaaaaaaaataaaaataaagtaaattaataataaaaacaaaaagtgaatttaataatatggttcacctgctgcaagctacataatgaatatgaatacataataagtcttaatgtatttttttttgaggtggagtttcactctgttgcccaggctaaag

SEQ ID NO: 1474 - DNA, 3414 bp, Homo sapiens
agggcaaaaggaaataagaaaaatttatgtaaaatatttactctggggtcttcttggtgggccatggctttggccctcagctttccagcagccaacccgaagctggtgcgtatcagttccttgattcacgctgttcacagctggtcaggtaaggcacggcttttccagttctgaggcctaagaggaactttgctcatagtttctcataaaaaggaccctgtgaggggtcatgaacagtgtccttaacatgtcatggacattgtccttaggtagacatatgtttcatgggactgtgtatcatataacatcctttctgtccgcctatggcaccacatcaccatgcccttcggggaaggcagttctacagggtggccaatacaatgggacttggctgtagtttcctgttagcctgcctagattcacaataggctttccggaatctagaggattcaggatgtagttctcgcttgcctcagtggagacttgaatgagtttatgcagtagtcatgaatgaatattcattcttaccatcgctgctgagcatctgagcccgctccttggctttgtggaattccctgagctaaggcagatcttgcctcccattttagagactgaaagtggcagctacttgcttttctagcctcctttgcagctaacaggtggccagatggcccagtcaccaccaaacagacacatcgccccaagttataaccatgacaagggtgctggtagtggctgcagaaggataatctttttagggcagcacgtgcagcacactgagtgggggcatccagtgactggagctagcagtatcagcaatggagactgtgacctcctcacttgacccaagctactgtccaggccgtaggagcctgaacttattccttctgccctcctgctgaatgtgtgatcttctcgatgtccttgtaatgagtgtatattctgcttaaatcagcctgagttggcttggttgcaagaaaaaacctgcttgatgcaagcagctgttcttctccgctccccgcccacccacatgcaaggcataggaaagtcaaactgctgtgaaagccaaggatgcgtacacgcataaggacacaagccaggtctgctcgcagagttcctgtgatagatagacggacagaaaacttgagggccctgcctgcagcacaggcctgggggcagaaagactgtcccagagcttgctagcctggaatccacagtctagatttatactgtccaatatggtagtcagtagtcacatgttactgtttacatatgaatttaaattagttaaaatttagtacgaccactatggagaatgctttggaggttcctcaaaaaaataaaaattaggctaccataggatccagcaatcccactgctgggtatatacccacaagaaaggagatcagtatatagaagagatatctgcactcctatgtttgttgcagcagtgtttacaatggctaagatttgggagcaacttaagcatccatcaacagatgaatggaaaaagaaaatatggtacataggccaggcatggtggctcacgcctgtaatcccagcactttgggaggccaaggcaggtggatcacctgaggtaaggagttcaagaccagcctggacaacatggtgaaactccatctctactaaaaatacaaaaattagctgggcatggtggtggttgcctgtaatcccagctactcgggaggctgaggcatgagaatcgcttgagcccaggaagcggagtttgcagtgagctgagatcacgccactgcactccagcctggggaatagagcaagattttgtctccagaaaaaaagaaagaaagaaagaaaatatggtacttatattaatacataatggagtactaatcagccataaaaaagaatgagatcctgtcatttgcaacaacacagatggaactggagaacattacgttaagtgaaataagataggcacagaaagacaaacatctcatgttctcacttatttgtaggatttaaaaatcgaaacaattgaactcatggacatagacatagagactagaaggacagttaccagaggctgggaagggaagtcgggggctggatagggggaggtgggtattaaaaaatagaaagaatgaataataactattattttatagcacaacagggtgactatagtcaataataacttaattgtacattttaagataactccaggagcgtaattggattgtttgtaactcaaaggataaatgcttgaggggatggataccccattctccatgatgtgcttatttcacattgcatgcctgtatccaaacatctcatgtaccccataaatatgtacacctactatgtacccacaaaaattaaaatataatgaaacaataaaaacattaaattaaattagttaaaattaaatagaattaaagatctgtttccacaggcacatcaaccacttacggagtgctcagcagccacatgcacctacagactaccattatgtacaagacacatagagaacatgtccagcatcgcacaaggttccattgcacggtgatggcctagaaccttgacattccaggctgagtggcaggatttctgcctttttgagtcacacctattgcttctggtggctgacgaggctgggagttcccaagcaatgaggcagcagttccgccctcctccatcctggtggtctgaaatccacaccagctaccaggaccacagagcactgggccaaggctctgggaaccctcttttccctgctgcatcttcgtctatgtcccttttgctacttcttgttggctgcttcagggggagacaaaagtaaagacaaccttgggtcaagttctcaccatcattctcattatcctggaacctggaccaggctctgcagcctgggctggtgcagaggccatctcaggtatgcaaatgagtgtgttatgcaaatgagtgcttcctacaaataaatgctttatgcaaatgagtttttgcattctctatctctcacactgggctgagcagggactttgtacttaccccaggacctggcacagggcttgacacatcaaagtactcaggaaacattcactgggtacacgtggatgtaacacagatcccgagggacctgacgcacgacaataatttccatgcagagtgtcttcctttcagtccaaggcaaggggggtgacacagtaataatgatgataatgagagtgatgatatgtatatgaaaaaatgaaagtatagagtatgagtttattataaaagtgtaaagaaattggttacatgtgtaaggaaatgtggagttatgggcatatttttcttttcaaattccttcaacattgttattacccatatcagagtagttaagaatatgctcagacagacatggtccccctttgtgaaatgggagctgttacc

SEQ ID NO: 1475 - DNA, 1967 bp, Homo sapiens
aaaagaaaattatggagcaaactcatcttggaatagcaatgctaaaattctaaattaaatattgacaaatagaatccaacagcaattaaagtaatacatcatgactgagtgaaatttattttattcaggaatgtaaaataaattttttaaaaagaccaaaaacttagaaataaatctatcaacaccaaattactcattatggcattcaaagccttttatagatgacacagttttctcttccacattaatcccactatttcaatgacagtcaaacactattactcactttttcttgtacttatgctatttcctatcccttaacctccgctaattttgtatctatgtttggaatgccatctgtctaaacttcctcccagttctaaatatcctatctacccataaaacccaatctaaatattaactcaaaaaagcttatttgattctccctacagacacctttcttctgctgaacaaccaaaatgctatctttcttgcagcactcattatatattttttaaaaacatcaggtcttctattgtcatcaagtaaacacttgttattttcagccatgtattacagatatttgtgtaaaggctctacatctcctatcagatataaacttttcttttttttttttttagggtaagggccatgtcttatgtacctttgtattctaatcactccaagcacaaatctttccatacttaaacattttgacgcacgagcacaaaaaaacccagattgtaaaagcaaactgaagacttgcgaagaatagtttccccttaaaatgtaactgcatgtgcacaggatgaagagttagaatctgaaaatcagctgggcactagccatgcctgccctgctacctttccatagccagaatcacagcagcatgaactgcactcaagctccagaccaagaaactctaattaccttcagcgagcaagtaaactgacagtaacagctattgcaggaggcaaaagcagctacaaccttcaattccaggcacggaggtgggaataaggaaagaagtcgggatggaactgttggtttcattaggttgttggtttggaagcaagtatttcacaaacacacccatccccccactatacacatccatccgcttcatattttcatttctcataatgccaaaatattaacttgtgttctaatatttcagggaagatgtataagctagtgagagtcataatgtcgagtttcaaaatgcatgtataatttgttatgcgtggcagggtgaacagtcctatcagaaatgcacctgaaggtttgctaggaacagaatattaaacagagcagagactatgggatctaacgtgataaactgacattaggttagaacagtacaaaaatgccacattccaaccactgttgatacacttctggagaagtggactttcaatataaagcagttattctaggtgcaattttaatagcaatgaaatacaatgaaatgacaaatctctggttcattctgaatacaagagttcctgcttattttgagaccatgtgaatcaaagaagtcgacatcaccagcactttgcttgtaggctaatctagtagtgacttttgatttcctgctccccctgttgatccatccatccacagctttaagaccagcctgactacaatcattcttcatgtcaccaaaatctccatccgcaggcaagaaggagatacccagctgtcccagtttgttaccccatcgcaagcacaaactgggatcactttctccaccccaactgtggtaggctgaataaaggcctcccaaagatgtgaacgtcctaatccccataatctttgaatatgctatctcataaggcaaaaaggattatgcagatgtgattaggttacagatcttgagatggggagattatcctggatgatcctatggactctatgtaatcacaagggtcctataaagagggaggcagaaaaatcagtgttacagt

SEQ ID NO: 1476 - DNA, 1723 bp, Homo sapiens
gtgaacaaggtaaccagcagagtggctagagtaagcctggcaggtcacgtttagaagcctgaatttcattctaaaagcaccaagaagccactgaatagtttcaagcagggcttgtcattatgtgttctacatttttgaaaggtcactctggctgctgtatggaaaatggatcacagagaggcaatcaacagaggctgatgatggtggtctagtctacagtagtagcaacagagcagcagaagtagatggatttaaagaggagctgacaggactggtgatggacagattggatgtaggggataaagaagaaagaggaatcaaagatgatttctgaatgagaggagagaccatgcactgagatggggaaaaccctagctacaaagaccacacaaagtgccatgtgccatggtacagatctctggaagcagtgggaatgttcagtcctccaagggaaatcaagttcagcttgcttgatctctgccttagcatgaatagcaaatgtgtgtgtgtacacatatacacacacatatatgcatatatacatggatatatgtaaacatatatgttttaatactgtttctgaaattcaaagcaagttttaaatcatgtcagcaatctttcgaagaacagagaggcagggttgttattgttgtcccaattaacatgcaaggaagctgatggcaaatgaggtgaaaggtcttttgaaggtcacacagcaagcagtcagcagcactgaaaggaggggcccggcttcctttcaggagtccctgccgtacatcacaccctctgcctatcatctggagcatgtggggcaccctgcaagcactgcgagagaacattctcggatgaggtaagggtggaggtgctgctccctcacccatgccattttctttttgctcatcccatcacaggtgctattttaataacccataaaatgtggctgataaaaccaaaagatcgttaacaccaaagcaaactttacagagagcaaatcaagtattaaggtatattgtggcatagatttttagacagacatttaaattatgaaccacaaggcatctactgcacaagctctccaaatccttctgagggctgcacaggtggagattcctcatgaatggaagaaacactcatgcccaggaatcacaggcctatcagtagcctcatctggaattcttcatccagtctttaggtttctcaaagaacatcaaaagcactgcacacattttaggaaaaaaagacaaaaacactagaaccaaagagttcacaggtctggtctttgtaacattatttaaaggaatacaatttatctagatgaaattaccactaaaataagtcagatcatatttaaagacacatgctaggggcaggactgggaagcctggacactttgtttagtctgtatactacctgtacaagttttaaaaatacactttcatttttcatctaccaggctctccctcagagctgtgaggactcccacctcaaatttagaagtctgaaagagaaacagtgaaggggtgtccgcctctatgtttgtccctgtgagtcatacattttctgttcctactaaatgtgggttggttgttttctagttgatttgcagacttcctctctgctgcttttctctaataatatttttccaaaggacccctaccttgcaagcacagtcccactaaggaacaacaggcaattatgcatgatcacagtgatcacagttact

SEQ ID NO: 1477 - DNA, 1628 bp, Homo sapiens
ctaatgatgatattagaatcatctaagttgtctttgacacgtgtttgtgctctttttgagagttaatttctgtgcaatcacaaatttaattggaatttacaattaataggtagacttctgcctttgtgagccattcaaattcaatagtgtctaatgactatttgattgtcatcatcaatacaatatgtattgtcaagcatatacctatatcatgcagtcattttaaaaattaacactaaattttatgccaaagggttaatcattgagaattgagaatagttgttcaggcaactgtgatatgtgttgtttgatgtgtgagttgctgtgattaaaacaatggccttcagtttgcagtgccatcagcctggtacatgtcactaatactgaattcattttttagagcagaaccatacatccaacttacattgcaattactgcagaggaagagagatggagaagttaaaatgaaacatttcaaggatgaatgggcactgaaaattggtaaagtggcagaaaagtccaagcttgaagaatgaaaaagtaaatgtatggagaaaaaggagtttggaaaacaggaaaaaaaaagatattttgcagaaacatctgtttgctgttgctaaaaattttagcatttaaatgttctcatttgggctctgaagttagcacttccttgaagtagttcacacctttgctattgctcctgttcagctacagatcattttatgcaaggctgattttaacaagaaaatggtgcattaatttacaatgtgttgagtgttttaaaagtggcaaaatctaggcttttgtaaaattttagaatctggaaaaaatagaaatacttatataaagctcttcaaaataccagaatggctttatgcacaaaaaattacatgctgattaagaaaattagaaaattcggtaataaaaaaagaagtacatctacctctaagccaatgggtttcctatgactctctagagtttctatttagtagtgaggcacatataaacttagacactattgaaatataatttttattataatccctcataattttcttccttccctacctcttctccctcttctttcttccactgtcttcttattttttatttctatttatttctttcctttcctttttttctccattgcctcattttcttttttctgtctcttttttttgtgtgtgtttcaaatgtttatttgtgttttcatttaaaatataaacttgaaagcaaaaaaaaaaaaaaatgcctgttcagggttctttctcatctccctcattggagtaactaatgttttggagcttcatatttctgaaatatcttaatatttcagatgcaaataagataagtaatggagcattttgtgcataatatatatacttttatatacttttttgtaaatatcaaactaataggcaaaattggcctaaatttatgaatgatgtttcactatttaacacaatgaatttcccccaattaaaattataaatacagtaattcctcacttaacattgttgacagattcttgaaaactataataaaatctattttaccataagccaattggtatatatcagagttaagttctcatgtcatatctgggtcacaaaaaaatcatcaaaccc

SEQ ID NO: 1478 - DNA, 2296 bp, Homo sapiens
taaaaatggttttcatgggaaataattaaaatgttaacattctgctctctgctttcaatgtcagtgtccggaaatatatttaattaatatttacatatcactattattagctgttaaaataatagcttacaatttataaaggcttttatatatttaacacacttaacaatcttgggaattgggcattattatcgttataaattttcaacttctttaagaatacaataccagaaatatactatccttcctcaaaggaactgatattcattctccttaatgtaaaccacatatatgtacccttgttttgccctgcattccctggcttctaggaacctcagattctaatacaatgagtatgtttggccattatatcaatctttgtagttagcatgctttctctctttctttgttctggttttctatttctgtttcatcagcctcagatgattattgcatatacaaattttcctaatctgcttcacatgtttgaaaaagggtggtatgagagagccaataaataaatgaatgaataatttggttcctagtaccttattttattttatttttgagacggagtctcactctgtcactcaggctggagtgcagtggggcaatctcggctcactgctgcctttgcctcctgggttcaagtggttctcctgcctcagcctcccaaatagctgggattgcaggtgtgagccaccatgcccggcaaatttttgcatttttagtagagatgtgctttcaccatgttggccaggctggtctcgaactcctgacctcaggtgatcttcctgcctctgcctcccaaagttctgggattacaggtgtgacccacaatgcccagccagtaccttgttttagagataggtgaagttacatgagcaaattataaagctcgtaatcgacaaagctgggccttcaaaccaggtctcctgatgccaaatcccatgttgtttccagaaggatccatctcctgagaataggggagttaagattttactgaattaatgccttgctcaaagagtgaaactatcacattttctgcccaagtctggtgcactgttacctccactatcttcttgagggtccttaagctcctaaaaaggaaacacaaaggaaggctgctcttggcattctcagacgttccacacatccagttaggagactgggcatgtttaaaaaagtaggcagtgagcggagggactctggaacttcaatttagctgctaaacacattccctcccatctcattctaaataggagggaaaaccgcttcctcccaaacagtctatacatctttgcctgtggaggcattgcagcagctgccacccggttctccctgcagctcagcatgaatttttctctttgttggaaagatgatataaaaagtcaatgtattatttatagtagttattttcatcattacatattcacaataattgaaaggtggaagtagagtataatgaaatggaatggaaagaaaattgtctccagtaacttcagaaacatttgtaggaaatgttcagctgctaaaaagactcccacaaaatacaaaaaaacaaacactggatcttaaaataccatgtaagccacccacatctgcaaagaattatttctgttgctatttatttgtccaaagcaatatagttagtgtataatagaacctgagggagaattctcaattccctccatgttgaagggcttgtaatgaagttgtttactctcagagtgagcataacttctgataattggcccaccattctaatgaggctaagacagtaggttttattctgacattacttcagtccataatcaagcactataccattgaccccagccaaatggctatcaaatatatgtttcagctacaaggagaactggttgagacaatgtagatggatcaatccaaatttattttcctcacgacacacacacacacacacacacacacacactctactgacatgtgttcccagtgctgtcttcatctacaaaagatagtgtacatttatcagatatcaacaaggtattttctgtaaaaaggcactaaactgtaggttttccatgtgtgatatggaatatatggattgaatagcacaaaaaaaccctttattgggaaagaggctttcagataaaagtaacagaaagatcttaaacactaataaaaatatattattctatataataagaagtttggagactcttatcagagtggctccaatgccaattgatgtcatggcttaatgatataattgtagctgaagtttgccccatcttttggctgttaacgcccc

SEQ ID NO: 1479 - DNA, 3113 bp, Homo sapiens
tgcacaagctgagtcaaagattccaaaagttttacccttaaacacattttggggagttgctgtcctttcaagcaagaaacaatttttacctttaaaaatagcttcaattgtttattaagcttatttttctcatatcagaaacttattttcaaggcaaggacctgcatttaacattgcacatgccttcaaaaaattgaacgcatcgaaggacactaaagctgggtgcatataattgacatgaagaaagcagttgaggcctcacaaaattcctgcttgtgaacaagtagttttgtcttaaattttccaaattagttgtcctatttaccaggttattgttcaatttcctacttgcattgcctggatccactctcagtatggcagaactatagtgactgaaaatttggtcagtgatctgttgtggccagtctatcaatttggtgaatggcaagaacctgggagtgttagtacctatactatgcaaagtgagctttatgttttgcagtggctgagccctataaactctggtcataacacattaattccttgttaacatagagccactttttgacatcaaaatttcctcaatagtgattatatagtcataggttcttaattcacttggagctttgatgtgtatggtatcaaaaacttagtgtataatatggtctatcattaaataaaaattggcatggtagaaagcacaaatggatgataatttagacctatgtttgaagtgtaacaaagcattagtttaagaattttatagaaatgttatgtttttgctctttaaaaagaacctgggcaacttatctgcttcagcaacttttggttttatgaataccttcctttacccaactctccctttccatcctttcagcacttacttactcaagtgaacttgtggatctgtttgtcattttttttttttctgagacagagtttcactcttgttgcccaggctggggtgcagttgtgcgatcctggctcattgcaacttctgcctcccaggttcaagtgattgtcctgtttcagccttgcaagtgactgggattacaggcattcgccccacacccagctaatttttgtatttttaatagagatggggtttcaccttgttggccaggctggtctcaaactcctgacctcaggtgatctgcccacctcggcctcccaaagtgcagggattacaggtgtgagccaccatgcctggcccttgtaatgtgtttctacatcaacagttgttatattggagcttgagttttacaagatatttaatttttccttaaattcttttgataaaacaaggataataatattcactgtgcatatttattttactgatgtacataaatgtatgtaaagtttctgctgcttaataagtgctcaggaaactaattaggatgtgtgttcatccagagatataatggtggtttctctttctttctctttagggtgaatattcaagaaatactgttaaatcacaaactactcagatgcaaacacaagagtgcatgctggaactggcttatgaaacacaagccagctggctgccctagaaaaagtctgaggaaaaagccttcttcatctaattcataaatgggaaattgaatttccaggcttagctggcttatttttatcttcttttgtttgtttgaactatgtattgctgaataactgtgacaacattgaaaagagggttcatgagtaaagcaagagttgatctttcacaaatcagtgctataatcatttctatgggagaggctacagatgattccatgcagggagcactctgtatgaatgatgtggcctcaggctagaacacttgaaaagcagcaaaggaaaactttctgcccaacttattagaggggtgtgtgtgtgtgtgtgtgtgtgtatctcacatgaatatattatacatatgtatatataacatatatatatatacacacacacaccactggtgtttattttcacatgcttttttatttttattttattttatttttaaaatagagacagtgtctttctccgtcacccaggctggaatgcagtgatgtaatcatggctcactgaagcctcgaacttgaactcctgggctcaaacgatcctcctgccttagcctcttgagtagctaggactatagccacatcctactaggtccaactaattttaattattttttgtgtgtggagatggtgggggcggggtgtctctctatgtttcccaggctggtcttgaactcctggcctccagcaatccttctgccttgagctcccaaagtgctgggatcataggcatgagccaccgtacccagcctagtttcacacttttatacactctcccaagtatcacagggctggaagcactttgattttggtgtattgggtataatttatgttctgtcaatgaaatgcaatcatgcaatattccaaaggcagaatagaggctcagagaacccatatgttaaaaaaaattattcctttgacagataaataacactttttctaatttattgattttgtaaatttggaattgtgaagaatctcccctcccccaagaaaaacctgtttgttcagcattccttgcaatgattgaatcctttaccagacaaacaagatgaatgaattatcttttcttcttttcctttggcttactttttctgtgacattgtttgagagactgagcacagtattttgaaacagatgacagggttgtcacctttgagtggcacaaatttagtagcaacagtagggcgttttatgacaatttctttacagtatgaaatccaaaagttattctctgtgccttcatgaggaaatgacattgagtggcaatatttaagatggtgattgggaggaaaggcgagtgtgagaagggcagcctaattttcatgaaatgaaacagccctagacttgcaaaatgataatcgtattactgaacaatgtgatgattctctcacatgaattgttcacttccaggaggcattcaatcaggcaagctatcaagaagatctggcctttgataaacacatccactttaatagcagttcccgagatgaaatgtttggatttatggcacccaatcactgcagcttgaaaatatgaaataacttgcta

SEQ ID NO: 1480 - DNA, 1153 bp, Homo sapiens
cttgagttaaatcctccggtcatgtttgcgctcagttcattagggtgaccccaaaagactttattcacatggggccacaagtgcatttttgacatttttaacatttggaatcggctgtcgtattgtgcaaaatactctgttctaatttagaatacttccaaaaaaccagaggaacaatacgattggttttcctcaactggtgaaccttcatgagcacacacggacattgtagatgtgaaaagcctgaagtcaaaaacgcccagccatgctgatactcctgggtagcctggtgaaaaatatcttgttattttcttttacctttttgcttgataatgatttagaaataaatttactttaaaaataattaaactggatgattaagttaggtttctaaataagatattattttagacattctcagactctgcccagtatcttcaggaaattttgaaagtggctatatttttgagacttgattcaatgtaaatatcaaattttattcttccatgtatatgttggttcaaatcaattatcttatggctaagatcgtaccaaaacttgtctgtgacgatcatcatttaggatttgaatactagctatgaaaatgtttttggcaaaattggcattattttcttttttctttccactttttaaaagattatacaatgagcatggaccaagatactaattaccagttcatatgttaatacttaaaagatcttaggtggttacagattttactgagttttaaatgtaatttcagttttattgtgtttttatttttatttctttattttattattattatactttaagttctagggtaagcaatgtgcacaacgtgcaggtttgttacatatgtatacatgtgccatgttggtgtgctgcacccattaactcgtcatttagcattaggtatatctcctaatgctatccctcccccttcccctgacctattgtgtttttaaaacttgttttccacaagcttctattttactgttgaaagaaattaaactttaaatcaatgtactttgtttcatacaaggacgaattctgaaaatttgatcaggtttgtaatgtaatggtctatttttgtattcttctaagtagaatatttctacagaagaaagtgagaatattgactatgaataaa

SEQ ID NO: 1481 - DNA, 4933 bp, Homo sapiens
ctgttaaaaagtctcaccacacatggactcacacacatgctcacacacaggctcacactcacacacacatgatcacacacaggctaacactcatactcacacaggcttacacacaggctcacagacacacgttcacacatactcacaggctcaaatttatacacaaacatgctcacacacaccacacacaagctcacacacccacatgcgtgctctcacacacacacatgctcacacacaggcacacaggttcacgcacatcctcacagacacgcatgcacacacaggctcacacacacaggcttacacacacacatgctcacacacaggatcacacaggcttgcacatgaggttacacttgcacactcacacacatgctcatggccacatggacccatacttgaacacacacacatgctcacagactcacacaaaggctcacacttacagtctcacacatgctcacacacacaggttcatacaagcttgcacatgggcttacacctacacacacatgctcaaagacacacacgctcaaagacacacacacaggctcacactcatatgctcacacacacacaggctcacagtcacacacatatacagagtcacggagcacagtgctttagggcagtggtccccaacgtttttggcaccagggaccagtttcatggaagacagtttttccatcagtgaggaggaatgggaagggatgatttcaagatgaaactgttccacctcagatcactgggcattacattctcataaggagcccacaacctatattcctcccctgcacagttcacaataggattcctgctcctatgagaagctaatgcccgctgatctggcaggaggccgagctcaggcagtcatgctcacttgcccactgctcacctcctgctgtgcgccccagtttctaacaggccacagactggtactcgtccacagcccaggggttgggaaccactgctttaggtgacatatatgacaatgtctcttctttgtaaactaaaaggaggcctcctatgtgttttgatgccctgatcaaacttagtattaaaaattgcaaaagcttctgggagagctggatcacgcctgtaatcctagcactttgggaggccaaggcgggcggatcacctgaggtcaggagtttgagactagcctgaccaacatggtgaaaccccatctctactaaaaatacaaaaattagccaggcatggtggtgggtacctgtaatcccacctactcgggaggctgaggcaggagaatcacttgcacctgggggcggaggttgtagtgagccgagatcgcgccattgcactccagcctgggtgacagagcgagactccgtctaaaaacaaacaaacaaacaaacaaacaaacaaaaaacaaacaaaaaaagctctaagagaaataagattctattttatacataaatgcctctctgttctgaacgactgacaaatattttgtttgcttgacttttaatggctcaggtaggacttaaatatttgatgaactccatcagtttatagcatatttgtcaaatacaaactctgcaccttgtttaggattaaggaagaaatgttttgtttgtttatatcggcaagtttttgaatagactgcacactgtcactctcctcgtatttaaattgcttatctcaggttgccaaattcagcatctgaactcctgatttgagatctctcgttctcttattcttttgtgttttaaaaataatgctgtcacctaattcctagccatatcttttcaggggatgttggagtaagcaaaaatgaataatttttcctatcttttagattttttttcctaaatgtgtgaaaaaccttttctctatcaaatagtttgtttaaaaagaagaaagaaaccagttggcagaaaatatattgacaattgcttgctaaaatatttcagggtaaaaaaaatcatgagatctatctaatttttataagtcactgattagctttatgtgagttatacaccttttggggtgtgcaatctaactaaaaattctcctgaggcagaggaggcgtttccaattccctctttttcattatatcataatacctttgcctccaggtgttaaaattgtaatcatagcctacacaaaaattgtcatttagaaatgtattatgaactgaagaaaacattcaacatataaattgatgaatatcgacgctccacctagatgtagaaaatgacatgattggcatgaagggtactttgattgagaaaaattaggactctgttaggacggaagaaaacttagatgattgttgttggataggccctgaatagcattcactagtaaacctggttgtcttccttgatgaaagcttttatggttttgatgggcagagctatgattctttttcttactgtcacttcacagggctccacatagtgccaggctgtggaggaaaaggccctgagtgagcaaagctgatgggcagagtgatcttccaggcagcagtctagtccctgaagtgagaggggaattaatgtaaaatttgtcaaaagtggaatttaaggaagtcaaaacagcatagctgcattagtgaatgattggatttgggcagatggggagaaatgaaatgagcccactccttgtcttttgattgagagggagtggtatcatcgttgaggaaggagatagaggcgaggaagccagttgtggagaagggtgtggagagaatgaattcagctgcagtgagctgagctgagacatcattgcagcaggttgttttgatggaggtgataagaccagacccaggctgggtagggtagggagggcattcctcaggcacaaagctgacatcatccacgatagctacagaaactaggcttgagggcatgtgtacgaaggaggagaaaggtacactgaggccagattgacaagacaagagaagagacagtaacaattaaagatttttaaaaagtatactatatctaccgtgggcaataatgaaaggtttttaagccctacacttttaatagggaaattctggtaaattagccaggcaacggtatgcaaaatcacatgatatgttaagaaaatagttatttttcccctactatgtttcagacattgcagtaagcacatgaattaatagtgaataagacaacagaggaaagaatctagagataggtgtgagagttggaagtctagtgggatatttcaggtttaaggataaaagacttgatttgaagttgcactagtaaaaaagagaaagagtgttttcatttgttttgtctttttggttttggtgttttgttttagaaagtaaacagaatgtgacatattgttgaaaataggaagttggaatgggaagtttgtaagcgatggacatagactatgaaagactggctcttgtgaaaattatggaagcatggacagaagcggagcaggagggaggggccttttgccatggggagtaagtaagagaaatctttttactttattttttgcaacaactctagagatactttcacaaagctttgcctacattttcccagttattttattgtatgtccttgagattttatccatcacgattcatctagagcatgaaactttgagatctcttgtgagtttttcttcctatcctactttaatgagatcattacagttggacagaagaggtggaatataggtgggtagttgtgtgattaggtgtacgcatctgagtgtatattctctatgttactgtgaaaaagagactctacttttaaggtgaacattggcgagaaactagttaaattttatttgcagttaaaagtaagtttatattggataatgctattgcatttcccacaaaaattaaaagcatcaaaatgatacatcaacatcaatttaaagcaggccacgtgtctaactgtacaagcctgttaaactctcaaacctgcaccaacgtgttatgtagagttccctgggcttttgatttctcgtctttgaaatgaggaggttgggacacataatttcttaaataccttttcatttttattgatgtgtctgattatgtataaaaagtacttacagggaaaataatcagtttgatctcccttgtaaaacaggaatatgttttatagaatctttccccatctgagagaagagcaaaccatttcccatcaagtcaatgtataggattgtgtgtgtgtgttgtgtgttgcgtgttttggggtaggtagggatgcccttttatagttaatataataataaattgattctgttttaatttgaaatatctacagtgtctaaattaccaaatccttaattatccagttaccagcaatgacttccaagtcccatggatttagatacatttgaaataaaccaccagctacctcaaatcttggaaaaaagcccattgcccagctcaaaaattacaaaacttcccaaatgtttatatatgcaaggtcacgtctgtctcaaagtttatcttcagctgttttcttctgttgcaccttccctagcacagaactcaaatttacagctcaaagacaggagagggaaatcttttaaaatttatttaaaaatggaataccctctctattatcaattggttgcatacagtatcctatgcaagttctcaaaagctaatcagctagtcctctacagagatactatttctggccacttgactgtaagttccagtttcctccaagattgcctcctcctttttccccacttctctctttagcatcccctcagtcccgtttacacctgctaactctgtcgtctcccttaagcccttaggtttagaatcactcttttcaaattctaagtggcaggaaattcattttcctaaacaaagatggcttcttcctaactgtaatgtgggtaggactattaaaatcatgtatgcacaaatctgtgtgactgcatggctctctgtgtgtaccccaattga

SEQ ID NO: 1482 - DNA, 1424 bp, Homo sapiens
gccctgtctgaagcttaggtcagcttcatttcccatggaaaccttcattccattcagttattctaattgttacaaagctcttgtctgagttgatctgacatctgccataattccaaccactgtatctggttctgctacatttgatttgaattggggtgttggtacacaaatggatcagaggaccccaaatacgttgcttacttgagaattttgtcttgggctctgtgcacctcagagtcacaagagtgttatttcttccacatcaatacacttctcctccaaaaacatcttacatttgaactaagtgtgctccacttttaatattctaagagaggcatgattcaaacacatgcaaattcacccactcagctgagtgagtaccgaggcaaaatggacaacttttagttctttcagacattttaaactgtaaaaaaaaccctgatttacaaaaaactgaatattgctttttttattttattttgaatattgctttttaaagtcttatttcattcaagtaaatttaaatgtcttcagtgaaaaatgcagaagatacaaaacacagtaatttaatttcaagtgatttaaatgatgagaacaataaatcagatattcaagttaaactgtgatacaacccatagaatttaatccatgaaggatatggtatcacctacaatatcctattcaatgcaaagatgaagagtaaaccaaaaagaaataggcactaccagagcatacaatactaattttacatgtaattaaaactaacaatttcttttcatttatagaacatactctgatgacctttgaggttggtggcaggataggacattagcttataattgtgctttgatttgcaatgaaaaattgaaatgactattcctttcctctctattcgaattaaagcatgaaacattactgccctctcctgatatattttggtagaacacctcctagaaggaattttgacctgaaaccaaattttaaaaatcattctacccactagaaatgaacattttccttcacgaatttatatcaatttaattttaaaaataattatttcacatgtctttttaaaattaaaaatggtgcattaatcttttgaaatccagatataaattaatgagccagaaaatgttgggaaaataatgatggctgttaatatcatgcatttatatgacatgttcaaagagtacttaatggaatttttctcatttagtctcacatcatctccaggaggaagtaaatcattatattttatttgtttaacttgttaggtctgttgttgcagctcataattggtttttcaagtgcaagttgtaggcctttaatttggatgcttttgtgactgagttatgtttcttcattctacaatatcaacataagacggtgcctaagtatatgtaaacagatgatgaagtctcttg

SEQ ID NO: 1483 - DNA, 2842 bp, Homo sapiens
ctaataaaaaacaactaaaataatcaaaataaaatatgactgcagctatcattgaacaatttttaacatctttgaatagatcaagataaatgatggaagtcactgtgttccttgtcccccattccgatttctgttatctgagaaagatgcactgaaaattacactccatttaggaagataattctggagaaaacatgcctgtagcctaaaaaagtggaagtgaggaataaaacagtacaaataagtagaatgttgagggcagaaatcaacaaaattcaatagtttttataaatgtagctgatataaatctcaatccacaaactcagatcagcaaggtatatatatttataaaacttgggtatccaaaagttttgactctgagcagaaaatagaaaattcaactttgcttattttcaggccctgaaaggtatgaacatccagggccgtactgaatatcaggcagtgggaagccattctccttggaccgcccaaaccacggcgaccacacttctttcaggcccacgtgtgcccgtgccatgctagcctgctgggtgacactggggacctgcattcttgcctctgcaggtgcacagttggaatttccaatgggagtcttgctgcctgaaggagctcccagaatcacctcaagtcccatagctcattcaaggaggtctagaagcagcagagcccctcagccaagagaccctgctctcagggccctgctctaatcccccacctccccttcttggtgtcctaggatttacccccatccctttcctggctcccaggacttttctcctgcacagaccctccagaaaacccagggtaatctctacagggggtgtaggcttttacaaaagacagggagagacagactgctttcatcccagccaaaaaccccagaggagttgggggtggaggagggatttctaaaagaattacaaatcctggctacttgcttgaaatgagaaggagaaaattccgggaagtacagaaacaatgtactatttcagtaacgtatcttggccacataaagaaagaggatttaagcatgtccaaattaaaccgtaatgaaaatgcttacggcaagaaagcatcagagaaaacagagacttgttgtctagtttaaaatcaaattttaaataaagttgtgacatcaaattcaaagagaaaggcaaacaggtctttggaagctatgaaagcaaacgaacacagacagtttaaaacctgcagcttagcagtgttgcttctctgaatacaaaggtgcctggtccacgatctctgttctgaagggtctgacacagaagacacaacacccaagaaaggagcacaggagttctccagtctgcttattcagccctcggggaagctgtccttgcagcagctagagatgtcctggctctcacagtgagatcacttgctcaaacagatcaaattcaccaagatgccactgcaaatagacatcgttcccttcagaatcctggctaaatagagagcaggtggtagtggctatcgtcttctaaatcaagttcattttcaagaagagcaatcgtgtttatccttgcattttccctacattgtaaaatgttaactggaatatataagatgattttctttcacatttcaccatcctgattaacatttgctagtaaacaaaccaacaaaatgtataaatgcattactgggagataatgaatgaaaatatctcttagagttttgttgtgagaagaaacagaaaactgggttggttgttggagatggaaaaactacaagtacagatttgtggttttttgtttgttttatttttgcccctttgggggagttgatgtgtaagcgaacgggcatgataccatagaagaggaaatgatgaagcaaaagagggaggcaagaatttctagtcccatctttgaggagaggagagggagtaattcccagtgggttcctggagtagttggccttagccaggatcacgttggttcatgtaggaaccggaggatgcagaaggtgaacactgttgctggacattgacggaggacatcatggggtccaagaagtcttctaatttctctttgtgaatggcaagcaagagcatcagatgcctcccagcacttccatagatgccattgcttctcgttttgtgtgagttacttctgaaaaactcctttctcctacatctttaacctctttctctccattgacttcttctcttccatttaatggcattttttaagtttgcccaatcttaaacaataacaacaattctccaaattttctccactttggctactgtcattcaacaaattcttactaaacagctgctgtttgccagatcctgagctgatgctaggaatcagagacaaatacaaggagattctgttccttgggagcactaaccagctacaaggcatgtcctctctttctcccttcatagagaggaatccaaggatagttgtttataatttctgtctccattttctcacttctcattctatcttctgcttattgcaatttgtttcctgcctcaggaattcactgagattcttctagggtccagtgatctcaatgacaaatcaatccctgagtcattttcatgccatattgaatgttgtgtgcacactctatgggaaacctcaatgatttccacctcccaacattcacattcttctgtaacccactcccttaactgcagaaactgtgacttgcttataaccaacagaatatggcaatggtgatgggatgtctctcccacagttatgttagaatatgtaagactccatttggcagactggagtgagagattctctttgttggcttgataaagtaagcagacatggagaggaag

SEQ ID NO: 1484 - DNA, 2241 bp, Homo sapiens
gagagacaacatcagaagctcagaccctcctcctcctctgagagaaacatagcccattaatgcatgcctacttaaagtaatagtgtatccctgatgttctacttactgctcatgtagtgtctacaactacagaaggaactccatccagtctcccagtcacttattgaatgactttcctcagtcttaacagtaataaataagactgaggaaggaggatcatttggaagccaggagttcaagaccaccctagaccccatctctacaaaaacttaaaacaatttaaaaaattaaacaataataaataaacattacgcaaagaaacatacaaaccaagaaaccctccatgggcatttttactatgctgctttcacatgattcaccaccaacgtcatgcgaacagctgattctgctataaatcaagtcttatagtgcagatatcctggtaaaatgattatttttaaaaagtgaaaagacttttgagcccagattaattgcacaactcacttatttttagcctttctcgaatcgataaacttctatttaatgatcacttagacattttctttaaaagattatttaacaagggcttgtctatacttacaacctgtatttgcaatcagtttatgaaaagatgtggtgagtggcccagtagcccctgattagtggctggcaagtccagcaggtttgtgctgttgtacacagatgaacaagaccaagaacaaacgacatattcagatttttctctcctcaaaaggcaacataaaagattcaatgagcctgttttgactgttactaataaataccttgattataaatttttaaaaatgtgttgtacaaaaattgtaaaattcttatacctaagtacatgaacaagccaggcaattgaaatattaattacaaaatattttttaaaagaatatgataaaaaaagagacactttaaacattagtatgttcctactactagataagatctttttggtttcctgttgacttgaatttaaaaggagactttaaatataaaacatgcacaggagaagttcttgctactataatgaaatcagctcctttttatgtagaaactgataagtcttttgctagattgtctgtacctgctgtcttaggtgaattatattttagttcagcattctttataagctgcaggaaaaaatgggtattttatcataatctgtgctggccatagctattagttttttttgtaaacctgaatccaggacttagcatatattttgtcatctgatgaaaaatgtttaaaagagataaggaaatgaaaagaaatgtaaattagatttattgtgtgaaagacaattattcttttatttttataatatattcagactctgcgtggagaggaaactaattttagctgaattcttaagagagaaaaggcaccagcaaagcttcttaaattagaaaaaatcctaaaatatacaacttctttctctaatccagaatttgttagacttatttgactattaataccaactgatggtaatcaatacttgcatactcttttcatttttaaatggttttactcctttgttctgcttatggttgtctctgaattaaaattttagaaatattctacagagatgcactgtctatttccctgctatttatttatttattaaggccaagcattaatcaatccatcctagttgaacaaaggcacttatttgttctcagaaacacagcaccggcagggcatgtgtctcctagcacagcagtccccaacctttttgggaccaggggccagtttgggggaggacaatttttccacagactgggagttgtggggatggtttcacaatgatttaattgcattgcatttattgtgcactttatttctattactattacattgtaatatatagtgaaacaattatacaactcaccagaatgtagaaccaatgaaagattctatacagttctagaatgtagaagccctgagtttgttttcctgcaactggatggtcttatctcaggatgagaggagacagtgacagatcatcaggcattagattctcacaaggggcatgcaacctagatccctcacatgtgcagctgacatcagaatttcagctcctgtgagaatctaatgccagggcggatctcacaggtggtggagctcaggtggttatgtgagcaatggggagcggctgtaaatacagatgacccttggctcgctggcctgccactcacctcctgctgtgtggcctgg

SEQ ID NO: 1485 - DNA, 3589 bp, Homo sapiens
gcagccctctgcacagtaactgacacacactaagcatttaataaaagctgcagtaaaccagaacgctttattaactagaatacaccatgatcctgaacaggccacataaaaagagctcaaagaaacatatgcaaagaatgtgggcaaatgtattttcaggttatcggagtctttaattacactcgcagggagattgaaagcctgctttcgcagtgcttttgacagcagaaaacaaagtgtgcttttttctctctctcagcccacggctctgtgtgtaagggaatggtgtttgagagccaatgttcgaggaagtaaggaatcattttgaggacccagatggggagtcgtgggaataggccaaaagcttgtcaaaatttcaacgtggttaaaaaaaaaaatcacaaaaatcacttaaccacacaagttttaaagtacattctgacaatttccttaaataagggctgtatctacaacagatctgatttaaagtatattttatgcattcaattgtcgaaaatcaactccattctgcacagattgccatattttttcataacaaatgatcagagatagcattcttaagaaagcccacccagaagatgttaattaagaaatattgatattttcccagggttttctcattaatgtcactcagttcatagaggcaaacattctaatttgaggaagcaagcaggagactgcactttatttattcttttcacgtatttcttctcaagtatttataaccattagaaaagaaacaaactttgcatttgcatgttgacaaccaaacaggacaaataagaaatatttgtcacaattctccacatatcctaaatagactccaaagaggaaggcactgaaggaacttctctaaatatagtcaaatggcaaattaacctaaaactcagccgagtaaagaataacttgctcctacttcctcaacacctaacctgagttgagactaattgtgcctctgtataaaaaggcctggtgttttctttgatgggctaatatacatgaaactttggccagaaatggttttgtgcaaatggtttgcatcgcctgctcaccaagtgtttacatccactccaggaataatcaaagatattaacctctgtgcacacgtcttcagccaatgctgatattaacattttgaggaatagtctgaatcaaaacaataaagcatttttccattcaacagatattttagcaccttcaatgtacaagcattctgctacgtatttagacaaaatagaggtgaaaacatcagtggcatgtcactcaggaacttgagatctagttaccagagtatacaactaacttaaacctgtacccccagaatataatgaagggcaacagaaaagtaaaagagtggtaagatttcaagacgagaaaaagactttttttaggtaagtgtgagtcttggctatcatagtggtgattagatccctgggtctgcacgacttcccttcatattatatagcccagggtgtggtcttttcatcttttaaaaaattttttttctttactcatatttgctgttgttgctgtcatttctgtaaggtaaggatactggaatggtcttatttcatagacattaaagtaataaaagcaatttgttgactgaaaatcaactgcaaatgtttatttagaaagaacacgttatgtaaacaaggaatgaaacctgattttctaacattcaggagagtgatttggcaacacacaggaaaacaataaaagtagccatattaaaaactcagtagttcttctttatcacagaattttactgaaagatgtgaatggagattaatgttcacaaggctttaaatatgtccatttacatgctgtttataatagagaaaagttggagtaagcctgaaagtccagcagtggtggcctaattaagcacattattgatatttgcactgtagactactctagagcccctgaaaattacatgctggagcacatgaagtctctgaacgaattctgagtttatattgttcaacgcaaaaagcaaacagtaatgttgattgcaatgtatgttaatatcttcagctatatgaatagagagaggaaatggggcagccatgtttatctccaggtactggggtcaaagccatggtgggcatttctgtttatctgcagagattttttttgtctttagttttaatccatgaatatatattactctaagggggaaaaaacatatctgtcaagataaaaaaaatacttagctcccaaagtaaaagcaaaatcaaacaaaagcagataaaaacaaaaacccagaaatattcattatataaaccccagattccctctatggctccaacatggccagactccttccttcatctcctctgaagtattacaggtccttcgtgcttacaacttcatgcccactcctacggaattcataagcttcccagaagtgtcgcatcaaaccctgtgcaaagtgatttcctcccatagccacccccactcacagctcagaacttgaaaggactgaacctccatttcaaggaagtcattcccagtggactctcctgaaaccctgtgggtctttcccacctggaagaagtagggtgtagggtggtttgggagatggtcttattttcagagcaacaagcccttttcctgcctcctcccactgcctgaccctggcaggacgaatggctctcaaggtaaaagctccacttgcctctccaaagggtcacgactcatccattcctggtggggatgcttgtgggtgacaatcacactgcctcccattcactgagtaattacagttggagacattacagcttcaaacactgaacaactgagattctgaaaacccttaagacaggaaaactataaacattaataattaatttgctttgacaactgcttcttcctttttcaggcatttacagtccatcaccttaagtgcaagcacattgctcgtagcatcgctgagaactccgcaaggattaaaaaccaacaaaaaaggatgcaaatggcttactagaagagatttactagtggcggggggattcagtgaatccactatctactctgaaagaaacatgctccttccaatctctcctctgttgactgaaatccacagatgtccgagccagccctctgcagtgcagatgcagcccccaaaagactggagcccctgcagtaaggacattcaagcagtagccatcagagatgctttgaataatcaactttccaccaacgcagaagtaaatgaacgataagcaatgtaaacacataaagacagccagaaattgaacaaataatcacaaacaatgggaagcgaaataagaaaaaagaaaagtaaagaggactaaaggatttggggtttctttccggctatttttatgactgtttcttgaaatctagctatatttttgaaaggggagtgggagagaatttacattgactccgtgtactccagatttttttttttacttctccgatttaaccctgcaccactgtgtctcaaacgaggaaactgaggctccagaagccaaacagctagaaaatgatagagttggactaaaacaaagggctgtttcttgggcttggaagtcca

SEQ ID NO: 1486 - DNA, 2046 bp, Homo sapiens
catcacaaccgcacacacctcccagctctcccagccaccgtgcacacttcatcatcacaaccgcacacacctcccagctctcccagccaccgtgcacacttcatcatcacaaccgcacacacctcccagctctcccagccaccgtgcacacttcatcatcacaaccgcacacacctcccagctctcccagccaccgtgcacacttcatcatcacaaccgcacacacctcccagctctcccagccaccgtgcacgcttcgtcattgcaaccgcacacacttctcagctctcccagcagcctcaggtccctcacagcaggctggggtttcttcatcctgcacccctgcaagtccaggacaggggcccggatttgaagcgtggatagtcctgtgacctttggataagttactaaatgtttacaaacctcagggtgttcaaatgtgtacaaataaaattatgaaaatgaaaatgtgtaaattgaacaatcgatatttgttgctttgttgatgaaggatggctggcttccacaaatgcaaccccaggcagttcttcaggaaaggcggccatctggaaggtgcattcgcctttctgccgtctgcaggcttggcctctagccgggcgtccagcctgcctagccttccacagccctcactgaacacatcttctccaaaagtgcaaatccaacgagcttgagctaatcacagtgctttagagaagggacctgtcttcttccagctcctcaatggacttcgattctgctaacaggagccttgtttttgcaagataggtccagtctcgagcctttccgctccacagggctcggtccctgaacgctgcccagggcctccccacacggagatttctctttcctttcaccaacaccagaaagatcaaccatagcagattttttcatctgaaaggatttttttaaagtaactatttaaaaatggtgtttcctttggccatctgtattctaaatggtggctcctcccgccagaggcctctgtgagaactgaactgtagacgcagaggggcagggaggaggtcaaacgcagtttccagcgcccggggccgcctaactctgcctttctgcattaacacttgacgagcatattgacatactaggctttgcgatcctctttctatttttaaacgcttgatttatgcctttcagttggatcttattcaactaaaaatgtactgtgtgttcagctgaaaaagagtaaacattttccatggctatggcaatatgtttgcatagacctcaattacaaaattaacagggcagatttggttgtctttgttgagccgaagagattacaatgaaaacctctaatgaaaggagacatgagaaataagacctaaagacaatactaaacaagaacggctcgtttattcactaaatttgatttactagacagctgtgttgcttccattttagaattcaacaagtaagaatgtcatttctaaatggcagcaaaacccgaaatcccgggttagagccgagggtgtgtgggtcagggggtggacagggatgggcggagggcgtggggagagatggtgacggcgcggagcctccctgggccgattggcacgatccgcgctccggagtcacctgcgcgccagctgatgacacagtgtgaatctcctccaaggtgtgactccatgtcccgggactggcggaggcagaaggtgggaggtggggactggctgtgcccagcctggagggaagaggtgctcgggcctgggctggcggggctgcctcaggggctgagtgaccagcagagccctcagacctgtgccacgctgccctggaacggggacaggtgacccaaagccaggcacagaagggcgggtgtcactttcttcccctggcccgaaaggcccctgcccgcctggagagcatcaggaggctggcaggggactggtgccatggacaggccctggctgacgatggaggtgggcacgtcggcccacagaggctctccttggcctacactcagttggctcctgagccctttctaatgaggcctgacctggggcttcc

SEQ ID NO: 1487 - DNA, 1803 bp, Homo sapiens
taagaagcccaggaacattctgggaagacagcaatgcatccacatcctctttcaatggatttaaaatcaggattacctgtggcaacttgaccaagggccaataaagcttctagcatataatatagcagaatatgttcatgatctcctggtagggaaatatttctttaacaagatgcaagaatgccaaccatacagaacagattaatatatatgataacattaaaattaagaactttccttttaaagatggaatctcactctgtcaccccggctggagtgcagtggtgcaatcatagctcactgcagcttctaactcctgggctcaagggatcttcccgcctcagcctcatgagtagctgggaccacaggtgtgcaccaccatgcttggcaagaacttctttttctcgatagatgctattcacagtattagaaggtaagccacagagtgggagaaaacacaagcaacaaacaacccaaaagcaaagggcaagagactcaagcagacgctttacaaaacgggatttctaaatgacccatgaacatacgaaaaggtgctcagccacattagtaatcagggaaattcaaattaaaaaatgtaagatgcaccagaaagttatgaaagcctgacaataccaagtgttagtgaagatatggagcaatagggagcacaaatatactactattggaagtttaaatggataccgacttccactgtggaaaacagtacagcattttttactgaagttgaacataccttaagggacagcaactccacttctaggtacataaacaacagcaacatgtgcaccgtgtagctttatttgtaataaacctaaactgaaataatccaatattcatcaataggagaatatacaaataaattgcggtctagtcatagaatggcatactatacagttatgaaaattaataaactgaaaatgtatataatatcaaagactgtatatatgtatatatactcaaatgtaatatggagttaagtgaatcagtcataatagagaatatgttgtataattttatttatgtggtgttaaaagaaacaaacccacaaaactaaactatagtgcacaggagtacacttagtgctttggcagtagggatctaaagagaagcaaggtggtggttggccgtgacagtcagaacactgatggaggggtagtagagagagggtgctcacaggggaggatgaaagggtctttggggtgctggcaatgtctgtttattggcctgggtggttatatggatatttaccttgagataattattgtgcttgtggaacatttttgttttgcaaactccattgtaggtgtgttctacttcacaatctaactggacccctacctatcaccatatacaaaaattaagacagattaaaggcttaaatatataaaacttcaagctataaaaatcctcaaagaaaacccagcaaatactcttctcaatatctgctttggcaaataatttatggctaagtccttacaagcaattgcaacaaaaacaaaaattgccaagtgggacctaattaaactaaagagcttctgcacagcaacagaaactatcaagggaataaacagacaacctatagaatgggagaaaatatttgcaaactatgggctgacaaagggctaatatctagaatctataaagaacttaaatcaataagcaaaaaaaaaaaaccattaaaaggggggcaaaggacgtgaacagacacttctcaaaagaagacacatgagcagccaacaaacatatgaaaaatgctcatcatcactaatcatcagatatgtc

SEQ ID NO: 1488 - DNA, 1250 bp, Homo sapiens
aatgtatattacagggaaagattttggacaatcgcacagagacagcccataagagctggcctaacattaacatcctgtgattgtgattttcagaactttagacatgagggactttggactttagggattttgatcttttgggattttgatgttcagaacttcaacattcaggattatgacactcaggattatgatccaaactcatcactgtcaaaatatatccctgacttctctataatggctcaaacacctccgaactttgttcttgctcccatgacagagaactggtgaatgaggtgttcctcttcctcacgctgaactagggattcaagctgatgggctcagctgttttcactgtggtcacccctttgctggaattcaggcacgtggctgtacctaactccaaaggaggctgggaaatgcattcttgctgtgggctcaggaagaggaaaacatggattatgctgagaagccaatagcttctgccatggtattttacagctcttcctcccccttccaagctttctcttgctctgtttctaaggctgcatatgtatatgtgtgtgtatacatacatatataaaaaaactatgtttctatgtagcaaacttttggtcccatatagatgataaacatgaggaaccctcacataaacatggttgatgctttatttgtgaaggaaagggaagaatctgatattagggcccagaagacgcacctctgcttcaagcaagggagataaattctgctgtgtccacattcccattaaggcctttatcaagatctatccaaaaaatatattcacgaggggttcacgtccaagctggcaaacactagtacagcataaaatttccctgataagggcagcaaaatgctaagtatttccttgaggccctcaatgattccatgtactgaccaaggaacatcaatcacatcttagattcagcacttccatcaccaactctagaagctggctttcttctcagagcaatttttcaccaaaaaaaaaaaagcatattttacttcaaaggcatttaacatattcagcaataggtagaaacaattcctcactgaaatgtggacacagggaaatggctaaacacacactccgacattagttaccccataccagcctcccaaagcagctgactcaaaattatgcctcggcaaaaatgcgaaatcagcatatgacatagactttcatggtctatctcaaattaaatcactgacatgcaaatgacctgctctat

SEQ ID NO: 1489 - DNA, 3253 bp, Homo sapiens
tggtttccctacacaggctgtttcatggctttctttgatcgcaaaaccctgtccttcttccacttcctttatcttagcaaacaactttattgaaatttatttactttattgaagataagttgttcagaaccatttctgtcacactcctgtctctctccctccacctcccactttctcttattcttcctctttatttcccccatttcaaaggctcacctctccttctctgttcctcattcaatatccattagggtttaaattctttaattagcatttccaactctaagctctggcctctccatcagtaaacatactcaagtctctattttcacccccaaaattctccaaagagaaatgtatcatttattcactgtatccttatcccactttttgactgaagctgctttctctggagatctctaaagacttgccaataccagtgggtacatctgagagcattggacactctgatcaatcatgcccattaaatatttccttggtggcctatatgtcaagtcatacactgaaggcaaatcactcaatcttggacaaaaattcaaaagataacttctctagaatttcatagtcactgctgcatagctgtccaaataatagctttctgtaaagccttttaccaatctggagccataaatttaccataagaatcatgagcacggagatgggcgtgattccttcacccagacgtccatgacttggtctcctctgagacgccaccatgtcagagaggcccttgtgaccacccaaccaaaatgtggctcccatcactctctagtctcttactctgtgttattctttatagcattcatcaccacctgaaattattgtatctatttttgctcctcctctaaaaggtaagcactgttatgaatggtcccagaccactagttactcagtaactgaacgaataactgaacaaagaaaaagtgagctatagtaaaacatttgatgtgtgcttacatgggtttaatcacaacattgtcttctagggtcatgtgctgagtgagggcaagaagttccagggatagccagaagaacaacctttaaaatagtagaaggtgcacgctcagtccacatgcctgcacgtggagagtgacacttgcgtaccaatggtttgaatcactgcctgatttttcaccctgtgctgtagagcagttcctcatcacacggtattgtagttagtaatagagctttaaagcaaggaaaaggcagaatgcatgtgtgtgtgtttgcaagtgcctctgtaaccagactcctctatctaactccgttttaaaataccgtatgtgggcaacatctgtgcctgagatggagatttggccagaatgttaaaaaaataaacatggcggttcagctggatactggcaaccagctaccgccccatggatggccgcagagaagattcatgtatataaaatagtatattaaagtaaacttacaaaagcaaagagcaatcattgcaaccataattttttcttcctctttgggattctaattttaaaagcattaaaggagacagctgctcatgctgtgatatgcgctaaacagcctgaaggatagaaaaaaatatatttgtagctcataataactattgacctttctgatatacaatgttctctgtgttagctattcggttctatcaacagtgaagattgaacatgactttttaatagaaaacatggggtttcgagctgccttcacaaaggtgtttatgtattgttattttgtattgtagtacaaagactaagtcctgatgccctttgtctgacatgatgtttgtcattaaaaaaaaagagaaaagaaaaagaaaaagaaggaaggaaataaaagaaatagaaaggggggaaagccctcaatgttattgactgtgtttttatatgaagaattggctcataaccactttatagttgtgataaaagcattgccacactcgatcccatatgcaatattggcaacggaatccacgcagcatcgcaggaggacatgctatatttttctcccagaatagatccctcaagtggcaacatttatagggagtttccaataagatttaaaacactcacttgcagtattcatgtggcacatcctttggagtgcacagcctgctgcagaatgggtcatattggataccatgtactctcaaaggcgatctttacgatactcagtttttcccccttgaactttcccgttgcttagtagttgtgtatagaaacacccactggtagcagcttgactctgacactgtgtatatttccccagagtggtatcatccaaacaccaactgcagagcagcaggcagccagcaaacactctcttctccctcaggggacagtctcaccaagtagtaacccctgccaggagcaagaaacctgaaaggcaacctcatgcattacaattctcattcgagacaggccagatagtcccagggagtttatggtgacaggtggcattggttggcagactattattttcatattttaggtgggttatttttaacgttactgttaaagaaggttattacatcattattgaatcacaattattttcacagctatgctctagagtttcagttaatgattcacaagtttctaaacaatgctgaagactcacaactgggtagggacaggaatcagccctaaggagatttaaatatatcagacacttttgttggactccagagcaagcattgaagctgataaagtctgactgctgagccaaagtatagtggctgcaactgcatagtctgcaaagggtggtacaacttgtgactgcagaaaatggaaggcactgcctcgccaccagtagtcaaggatcacactctagtatactaaaagccgttacccgcttcagaattgccctggcacatggtagaagacaggccagtgggatgaaaaccaactctcaaaagacagagaacaaagtattctctaattctgggagaaatcaggccaacccccctttaactaccaaacccactggcctagaactctcaaaagaacactttgcagaaaacacttccttagagatgaatacaaggagaggatttaatgatcccctccttcaagagaaaaagccttcttgggacatgatattgtttggtgtgtgagagagtgacagggatagagtgaagaattcttcttagaagaaagtatctgaatgtcactttattttgacacgtgtaactgaatgcctacttatataaagcacaatcctaggcacaaggaagactggagaa

SEQ ID NO: 1490 - DNA, 2830 bp, Homo sapiens
ctcttctgtccagcaagctgcacaaagtcaaagatcctttatgagcgtctcctcctgtgtttttctgaaactcaaactgtgagctacaggtcaggttctggccacttctccaagtcagagaaaatgctctagaagtttaaaaggagagcaaacatccattttcaaaagaactgaaacttcctcccaaccctcaggacctgggcattcagttgcagtcctggcatgcagaggaaaatgccctgttggaaactatcagagaatcatcctatgtggagcttctcatggatacaaaagccagagccttacaacagaaatacttacacagagcctcagacaaacctgtaatgacagatgaatttgtctgttaagtgtttctctttacctattaagtaacttcaagtcttgcttctgaaatcattaggaaaatctgcaggagactggaaaattccaccagctcatatctgtctagacatactgacttccctagagctgtggtttctgcccagtgcttatcatatagaaggtgaagcataaacatctcacagaatccctgggcctcagatgaaccatggcccagtaaagtggtacaacttacccaagacagaaccatggctacaaatcaggcttcctgcttctgattcagtgtttagcaactgaggttttgtctttttggttttgctttgtttatttgtttgcttatttttgagatggagtcttgctctgtcacccaggctggagtgcagtggtgagatcttggctcactgcaccttccgcctcccaggttcaaacgattctcctgtctcagcctcccaagtagctgggattacaggcatgtgccaccatgcccagctaatttttgtatttttagtagaggcggggtttcaccatgttggccatgctggtcttgaactcctgacctcaggtgatctgcctgcctcagcctcccaaagtgctaggattataggtgtgaaccactgcacctggccagcaactgggtcttggcccatttatgatccaccggactagaggatgacagcacaggaaaccctgcagttctcagtcctaaatctgcatgtgtctgctaagccattgtatcaggatgactcagtcccaactcaggtgtgaaacagcagcacaatgcttattttctttaaatccttctgaatgctctaccactgagcagttagcctcatagttactgggccttccttcccctgtccccccaccccatgattaggccaagttcttgggagattcatgcaccacccaagctttccaaatgcccttctcattatcagtccacactggttttcatcaagatatgagtatctttgacaaggctggaaatcctgatgcctggtgtccaatctccccaacctgtctgtgtcggtccttcaggatctctggagcaatgccacaaagcattgctcctgttcccattattcattcatcaacctgtcaactgtccactgcctcccaggctgaggcaccccacctctccagcactctcttctctcatctctgggattcccagcatcttcttttttgttttattttacttttaagttctggggtacatgtgcagaacatgcagatttgttacacaagtatacatgtgccatggtggtttgctgcacccatcaacccatcatctacattaggtgtttctcctaatgctctccctcctctagccccccaccctccaataggctctggtgtatgatgttctcctccctgtgtccatgtgttctcatttttcatctcccaacttatgagtgagaacatgcagtgtttggttttctgttagtgttagtttgctgagaatgatggtttccagcttcatccgtgtccctgcaaaggacatgaactcatccctttttatggctacatagaattccatggtgtatatgtgccacattttctttatctagtctatcattgatgggcatttgggttggttccaagtctttgctgttgtgaatagtgccgcaataaacatatgtatgcatgtgtctttatagtagaatgatttatattcctttgggtatatacccagtaatgggattgtcccagcatcctcttttcaagaagcttggcaaatcaagaaaaaaaaaaaagaagaggcactgacttcaagcagcttctgcattgtggtcctataagaatacctcaggcaggaaatactaggggtctagttgtctagttagaattcaagagaagaataaaatattcagcaaacaaaattcaagtgagtatctcaaaatatttctctgctgcaccagtataggtcatgctgccttcggctgcctggtactattatattaaaatttttaaaataataatgggacagagctttagcaagaaacccaagacagcttgacttatagtattcatcctttgtgtatgggtgtgaacacacatacctaactttgaaacaatatttgtgtttatgcatatgtaagatttttgaaaaatctgttctcagagcactttaggaccatttccccaagtaagggtaatatcgatttacttataaaatactgtaaaaataccagcatcaactccatgctgttactttaagtctcactctgcatgggtcactttaggtctcaccacagaggtagtcagttgtgctggtcaggaatatacaccccagtttcagtcagctacacattccataaaaaaactctccattccagaagtacctacaaaccctttagtaatccttttctcatcaacattagacactttgtcaacagtgagtgttcaaatcggattctctttggggaagttaatggtattaaatacatgtgcagtggctaaaatattt

SEQ ID NO: 1491 - DNA, 2864 bp, Homo sapiens
tgtcaaatagaatcaacagtacattttttaaattgttaaaaagtggaggatcatgagaggggccagtttaattagaaataaaataaaggacacacatttttatccacatgtccccaaaagatatgtaattaaaaatcagtttgacctgctgtacatatttttatagaaattctgtaactaaactcatgaaagagatgtttattcatggtgaatatgattaaggttatccacttataaattattgaaaactgtaaaataagacaattttgagtaaattgaaaatgttgtataattgtaaatacaaataataaccttcttaggttgatcataaagaacatggcatatttttgctaagagaaagttgagttttctttgtccctactaaagatgtgttgagtaaataatgtccatttaaatgcttgtcaaagggtaggccagtcctgggcatcaatgtgcttcaatctagcctttcacccactgcatgaagatgcaactcacaaaagaagtccctgtcagtcatttcttagaatgtaaagtatattttactacattaactactctattagccactaattacatgttagacactacgccaagtgctttgtatatataaaacctcagcaaattattgaaacactataagaatatgtaataatgcccatcttatggatgagagaactaaggcattaaaaggttaagtaatttgccctttgtcacacaatgagtagagatcctgtaaggatttaaactcagatccacatggctccaaaatccatgattgaaatacgtatactgtatctgtcagactggtctacaaaagcctattaaacccaaaatgtagctgaacatagcattgtcattgtacctatagcttttaaaaatagtaaaatgggaaaagagattccaagtttcaccttgagacagacacactcatctcttccacccctgcaggggataagggcagaggttttctcagcccatccatggtttcctagctctaggacaggagactcctctagcttcacgtctgtgctggttgttgttcccacaagctgaggcaggactaatgatggacgctttcaaggctctgagtgggcaacactgggggttcacagtctcctgccacattaaagccccaggacatgactacatctgagatggtccctaccaccttcttactgtccctcctcaggcttcatggattgacctgactccttcctttccactgccactgtttcttgcttccagtcagggttttactattctctaaccttctgcaatatagaagttgttctctagtgttctgaatttcaaccttcttatcagacaaaaagcaaatcagaagttccccattcatcccacccttcccataaaatgtggaagctcacatttgcatataattttcagtggccaggctgagagattcaggtaaaagggaggtgaatataaccagttgctatgacaacagcaagacataaaatggcatagcaactcataggacaagcttttaaaattacataaatgtgaattatacaaaaagtcattcaaaattacatataagaaaatgactggccaattgaaagaagcataccacacaaataaaccaccttgaattaggcaattaaagagatatatataattctaaccctcaagggactgtgagaaagaggggaaattacaattctgctgtctctgtaatattacttgtcaaccatagtgatccagcttcattcacgttaaaatttttcatgtctaccacaaagctgagaattaagtcacaactacattacaaggccagcaagaatgaaacggaagtgtttgccttcaccatttgatgccgttggccattctccctctctttcttaaaattttctctcttggtttcctgacacagcattcatttacaaccttccctcctctcagattgttcctttctttctccatctggtcttcaccaggttttgtagatggttctcatccctttggtatttaaccacatgtcctcgattaatacctcctgtctggtggctcccaaatctataccttcactcccaaacctttggccatgcagatcccatgttccagtttcatgaacagatctccatctccacttgcatctccaaaggcatctcagagtcagcactcctatattcaaggtgaaagactatttctcctcttttctggattccctaatgaggttaatggcaccaacatcttccaggaattcaggcaaaaactattttagtcattgtcatctctttttctctcacatccaggcactaagccctgttaatttgacctctgtaatagctatagggtccatctgctccagtacaaaccagatgggcaccaacaagtctagaactgcccattaccccctcatcaaactgcaggaatgggctcccaaaagctctccctgatttcaggccttccttattccattattgcccatacaatcctgaccataagaattacatcagtttgtgttgtttttaaaatacaagtttctaggccttgcctcagacctactataacagaggaacttgggaacttatatttttctaagtattcccagatgattcctgtaatcagtactaccagattgacttaatttagagcccttaggcaaaatttttcatggcccccattgctggcaaaatcaagtcccagtacctgcttaacatttaaggccctccacaatctagttaacacacatccttccagtcatcttccccattgttacttatccataccttatgtccaaaatacactatttgtcatttccagaacttctacatttcccacccctcccccatcgtgggaaaatttttgtacacgtgtatgcttagtctggaccaccctat

SEQ ID NO: 1492 - DNA, 3424 bp, Homo sapiens
attttgaggaaaaacttgagagaagccccaagaaatgatttattcttcttagaatgacaagagatgagttgtctttgcaggtaaggcagtcagatagttatgtgtctgaggagactaatgctgttagaagtgctgaagggcaacaggaaaagttaacagaaaggattgtcaagaaggagggagggcccagccaggatttagagaaaatagacttgtgggatacaatctatgtgctttggtgatttttcccacactacttggcagctatggatagagggaagataagtatgggtttgccagattcgatgattgacaatccagccataggaggcagtttgggagtgagcaattctaagattcctgcaaaagccctatttaaatcatttctaatggattccaggctgggtaaggggcaaaagaagccagaaagactctgatgaatgaggagacaagagaagaatctagaaaatggagactcagtgaaggtgaggacagatcagcagggatgagagggctgtggggtaagaagtgcaggaagtaaggtcaggaaaggggattttccagcttgagctcttggccatggaatagttcccagggccaagcataccagtaattatttgtggctcaattatttcctagatccttgctatctggaggaaaagttagtggctctgagctgcagcatggggtctctcagctcctactttctattgtaaaaagtgagaatgttagccttgcagaactattatcctactttaaaaaaagatacatattaggtgctcagcagtttacaacatctctggtgattgtgtctaaaattatcatattctaaagccatgagggggtctatcaaggcaaatattttaacatcacttgaggactttgagccttatttcttcaaatgcttgcccatgattcctggaacctttgctttctggttgaagtcttggtttagcatgtgcagcaaataaaacagaacacagccactccctgagagcgtccccacctcccctctcctctcctgtgacttacgttttcctcagtgagctggctgccacctctgcagctgccctttgaagcatttctccagagtggtgactgtcattagctgtgctgcggcttggctgttctccctgccaactgtggttgtgtctgccctcactttccataggacgtgctggcaggcttggtgctttaccaaatcacagcggcctttgtgggtctctgtcagcatttctttccttttgctttctttgtctatgttgtttctagaagggagcagaacttggttgctgagtcatcactggctgtgatgtgggaagtcagaacagttctttaccttttgtttatttgtgatctcctccctctagaatgctgagagtgttttgaaggagaagattcataggaagaaacaaatttaaccaggataataggttgggatgggacacacttccagtccaatcttgctgtccacttggtggtagggaggggtcaattcactgtgctgtttcattgggacttactttggcatcctcatactgagttaagtgtagagaacacagtgatgggattgcattagccttcaaaaagatgcttacttgtgactggcctacttagaaaaatggagtggaaaaaaaaaaaggaatgttttgatgcagaaagaaaaataaggtagtagaaggtagaaatagagaactacagtgaaggaccaagcagatgggctgtatcagctctaaaacgtccctggactgtgttcttcctggccatgtcctggattttccattcctgctgacatttccaagtcataaatcaaggaggaatactcgaagagccttacgatttcgttgaaatatgagcagccaggacatcctctgggtggagtaggacttgcaggtgctggaggtgggcgggcaggacatgagttgaacagcaggcagggatattgggcagggtggccattgcccatggagtccaaaatttcacctttttataagaaactttgggatttgggcctatgaaggacagcccagtgagtcatttctccggggctgggatgggaaattactagtttttggtcttatgattgtgaaagtctgcagatgtgcaaccataagtcttttttattctcctttactctgccttttaaaactttacagttaacaaaaccttccctattctgccccaagtggatcaaatcctttttctctcatctgactccattatagtcttgagaactagctaggcacttttcagattaagaagctatgtcttgcccaaattcctgtcctcgtgacaagttttccccaaatctaggaccaattcctgatcaactgctttacatattcagatcaatgatggcttcagttctgtgcatattctaacacttgacatggacatctatcttaagggcttaaggactattcttttttttttttttttttttgagacggagtcttgctctgtggcccaggctgtagtgcaatggcatgatctcggatcactgcaacctccgcctcccaggttcaagccattctcctgtctcagcctcctgagtagctgggattacaggcgcccaccatcacgcctggctaatttttgtatttttagtagagatggggttttaccatgttggtgaggctggtcttgaactcctgacctcgtgatccgcctggcttggcctcccaaagtgctgggattacaggtgtgagccatcgcgcctggccctttaaggactattcttaattgcctgatgccataggctgtgggttgtgactgtgagataggtactgtgctaatctctagacattcatgattttgtttacattttacacccctgtgaagtagatattattattctcattttatggcataataaaatgaggttcagaagagttacataaagtgacaagaagctggtggtagctgagctaggatttgaacccagatctatcctacctcaaagcctaagtgcctaaccagtctgctggagactcaatctggagtccatgcccctgtcacccctagattttatgtgaccttttgtacatgtgtttttctgggaagcgggatcctggtctatatcagattttcaaagggctacgatcccacaaagctaagaacactgtacttaactattagagttggtggatcagttaggatgctcttggttgcaaacaaagcagaactgaactcaaactggctgtgtcagtgttcacgcacagtttaatcaggattcctgctctgtttctctgtaacagtcctggcttcatcctcctagtgtgtaggctttgtcctcaggcttcccttattgatagcaaaatgcctgcaacagttctgggtccaatgtctgcacacacaggtccaaaagaagagccaaaagaaggtccaaaggaagaacatttctctcctctctactgtccaacaa

SEQ ID NO: 1493 - DNA, 2014 bp, Homo sapiens
ctgggtggcagaaacaacacatgatgcaaagaatggaagctgaggccagaggaagaagatggaagaccttgaaagcaagtcaaggaaattggactttgccctgtaggagacactaaatcatcactgaaatgtcttaaacaggagagagatgtgatcaagaaccaagatttaaggtggtgatggaggaggagaaatccaaggagaaaatggaagacagataaggcagaaaatatgctttacaactttctgttctgtattctgttggaatctaaatatcccaatgagtgtggcagattgaacagggctcttagcctgaccagcttattgaagagacaaataaagattgacttgttagtagctggtaatgacaagcactattccttcttggccaagcaatcttcttataattggagaaagaaatgcttgtcagcctagcgaaaggttttcatacatggctccagggatctgtgaaccctctgaaatcgtgtgtaaaattctgcacatttttctgggagagggtctatagctttcatcatattttcaaaggcaatcaggacacacaaagtgggaagctgaagattaaaattcaaatattctaaagatggcctattctttgggctgacctgatcctaaataggagaaagacccgaacgaatgttcatacgtattttaatggagaaattttaggtactagactcctcacagtgaagtacacacagaaatttgccatcctcatctctagtgtaaatgcgtttatgggacatttttctaggtcaggtgcataagcctgactctcaaccctacagctttagaaatggaaaagacaaggtgacctgaacaaagagatgaacactgctcagagggaattgctgcagttggaacagcagactggttttgtatatgtagggaccgagggctgagatctctgaggcccaggtggtctgttgagaagaggccaaggtacccacctcctctaggcttttgttgttgtgactgcatctacataccagcaaacatgtgcttcctccctggccttgatttatggtgacagttacttggtacagcaggtgggtaggaatggttctctcagcaggagaaagtctgcctctgctgcttcatgacctgctattctgtaataatgagcctcaccctgtaccattgctaaggcagctgtccccttcagagtagccacattagaaaggttaatgcattcatagtgagcttagaaggggcagggagtagtgtcccaaatatgtatatgtgtttgtgtgtgtgtgtttacattcagagtctggcagataaccatgaaaaggtgatggtacctactcattaatctaattaatattggcctctccaatgctcacacattttttgccgatggtttggaattcatctgggctccagtttcttcctttgcaaaagaaagatattgcactaacatgataatgtcactcctgcttaataccttcattaaacacccactgcccccattccttagagccacagaatcctggggtttacaagaaaggttttaggtactcctttccttctgtattagtcagggttctctagagaaacagaaccaagaagatatatgtagagataagaaagagatttattgtgaggttgattatggagtctgagaagtcccaggatctaccatctgcaagctggaggcccaggaaagataggtatagttccagtctaaaccccaaagcctgagaatcaagagtgccaatggtgtcagtcccagttagtatctgaaggcctgagaattgagggaccaattatccaagtcctggttggagtctgaaggcttaagaaccaggagtgctgacgtctgcgggcaggagtaaatgaatgtcccagctcaagcaaagaggaaatttgctcttcctccacctttgtttttttctaatcacatcctcaacagattagataatgcccacctgcacgcatgaggacaaaatcttctttcctcagtctactgattcaaatattcatctcttcggga

SEQ ID NO: 1494 - DNA, 2177 bp, Homo sapiens
agaacaacaacagaaaaaagaaaatgaagggagtaacttggtaggtcatgtaacacagaaccaacctgccaggggaatgtgtgattcccccttgatataagatgcagaatggcagccatcacttgggagtgtgtcttttgagagcctccagctgttgacatctctaagcagattccagctgtgagggggttgggatgacgttattgcagtgaggcccctgatggagctaacaggcactgatctctgcaggctttctccttgtttgagagggtttagagcatgagaagcgcctggccccagttcctggcactttgtgatcttgggcaagtgaagtcacaactcagtttctctatctgtgaaatggggataatactacctccttctaaggttgttgtgaagagtaaatcagttaaggtaattgaaatctttcaaatagtgcatggcacatagtaagcatactggggtttgttatttgtttacttttgttaacctttgcatttttgggtcattattattgtgttgttttctttatccagttcacaagaatggatcagtacctcagaagtggttctttgaagtataaaaggagtgacaaaaataagaaaaactacagctcaaaataacataagcataaatagtgaagggaaacccagtgtcattataaaatgtgaatcttaacatccagggaccagttaatctttcaggttgataattttagtcaagtcacagaaaaagaaaaattgtaaatagaaagtatcataatgactttctgaaaattgaattttacttgggaggtgatttatttgtccgtggtctccagtgctttctcttttatgaaactttgtcaaataggggcataaaacccccaatgcttttgagtcattttcagacagagtacagtggcctctccagtaaaccagttgagtcttcccagatcaagtacaaaatagtgttttccagggtgaaactgatgaattttgttactaagggcccagaatatagaacaaaacctcagaggcatcattcatagttacattcatcctagcaaaagtagatttgctgagaagtttgcaacatcaacctccaaactgatggcaaacatattcaaaaggaaagaggaacaagcttttggcaaaatcgttgatcaaatactgctgttgcatgtgacgtaatatcaggggtatgcaatgtggaaagcagtcatgcatgaatgaatatttcactttatagtttgttgaattcactgtgtagaatatgaatcagtccttagaatatgtgtaacacacgagggagaaatgttcagtgactttctgtaatctttgtcgttgaaacccttcgcttcaggagagattctttttgttgtttatttggaaggcactgataatgaacaaaaggttcccagacattcctaatgacagggcaccagctgagtaggcagcaaggaagatgccactctgctaatgctcatcctccctccacttcttccaccaagagcaggatgaaaactccatcactgaatgtgtattttccactgggctgtgtaaatagattctcagcaattaaatagctcagcttttctccattgagttgtgctagctgttgaggagacctttttggaataaggtatgaaataaaatatttcttcatggtcttgatatgagtaaagaccatgtctgtgataatcagttggcttagacagatggcatattgcataggcttttctcttttcagactgaatctgtctcttcctggtcaatgacagaaataagaaatagaattttttaaaactggataatactgctgagactggatcactaagatctgactgtttactagcatgtatgattttcatcaaggaagcataaatgttgggcatatgtaacaactggaggtaaatataagcaataaatgaatgaagaatctatttcccacttctcttaattcgaaacattgcatctcccagacttaaaggataacttaggtttccaataaattccaagcgaggcgtttagtaaatttttccataatatctgggttcatccttggtggaaatatctgtactccttagtagaacaaaacactgcaacagttaccaacagtctgtacagtgcatgagttgtgattttctaattgatgttaatgaaaatatattaattaattagcttagatgtggaacc

SEQ ID NO: 1495 - DNA, 7121 bp, Homo sapiens
gaaacaaaaagaaaatattttcaaaccaggaacctaaaacatttaaaatgctacatcgtaataataattttctacattcagaagtgagatacaaaaagaagacttgattctcagaactggggaagcaatgaaccagtggcagagagaatcaggtttataaatgtctcacttccatctaggtgatgcaatagttgttttcattctttggtaggagctgtcaaaggctttatgtctataaagccacctaattaactatttgtaaatttttaaattgctcaaccactccatgagagtgccatctgattttcctctgattcagcggctaagctgatcaatgtaattgactcaacgcttctaaggtctgatcgtttctacagtgaagaatcactcaaagttcattccaaaaataaaaaataaaatgttaggtgatgttctggaaaaaactagcctcaaaatactctctaaagtttatgaccagaaagcaggctatagttagtggattactaaagactctgtagatattaaaaacactttggagtaagtagaaccagcaaaaataacaatgaggtgaagctctacctgccatatgatagctaagcttagtgtcagttataagcatgacagaaaaccctcagtacctgatcagttaccatgttttccacaaattaaccttatgttatctaaaaaccttgccccaccccccacattactatccaggagagatgcaatagagcatcccctttctcctcccaactgtgcttgaaaatttcaggcccagaatggcgatcagctggaagaaaaatcccttttaaaaatcaacagtactccatgctgtgtgctagatgttctgaggttccccaaaaaaataagcaaaatgagatagtgcagtgaatagaaattaaataatactgacaaatgactggaagaatttcaaaaggaagggctcagcgtgagttagggttcccaggaaaggcttcggccagatccaggtgtagacacatggaaaggggagacaactattccaagaaagaaaaacaatggtagaaaaagtcggtagggaatgtttgatacatgttctggtgatagaggtctcagacagagcaacaaaaagaaacaggcaggaagatagaccagacagcacacagagatccctaaatataccaagagtatataaaagagataaagatattttaagaaatgcttctgaaccttgaactgttggctcctctaatttcctgatttaaatctctgattccttgttttaacatttaatttcttcttcgcttttggtttgttgtattttcactttgcaccatcaattcttttgaatttcaaaaataacttcagcttcctgaggccagcttgacagttcatttaggagatcctacgtaacctactacttatagtattgcttctgtgaaccctgagtcgggagatgcagctggtccaaaggttgttattttaacaaccaaggttaatttttcttcctcaacataggaacatcctcagggaggcttttcacctgaggggttagctgagtgctctggacatactaaattctcatggtggccactggactatagcgacactcaactaactctattttatgggtttccttcattacattagcatttgagacttagagctgcttcacgttcattttctcaaaagaaaatttaaagggaggagaagggaatttgcagtgttccacagctgacctgggcaaagtgaacatcatctgggttcatctgggttctgtctatgactcttggaattaatgaattcctgaagcttcagtgctgtctgcctgagatttttggtgtgaaattcctacatagctgtgaaaacatcattaaatgtcagtcttcaagaaaaacttggacaacccacaaaattatctatgccatcaatcctttcctctttccaaataccttaaagtgtctcatgttaaaggaaaacaagaatttgactgtaaccaatatctagaactgttcatcagaagtctcgtgaacataaaaataaaagaaaaacacagagtaccttaaattctttttaggctagcacctgcttttctttaggcttggccagttctctttctgacttttggttctaatgaattctgtgtttgtagttcacagtgcacatctgcgagaacagttgggaatgagcagcaggatggaagtctattcatttttgggtatttaacctatttataacctacgtcatgctaaaaagaggatttggagtttctagcacaaataggtacgatacagcaggatataaatacataagaggaaaactcaggcaatacgtgcatttaaaacctactaaaatcctgagtttgttgaatcctttaccacaagcatatagatattcttccctagaaattcccaactactacaaatccacaagtaaccaacaactcaaatggaaagatctatgaataaaaaaaattatcaggcttaaaaggcatcctcttatgtgttcatttctcttatgttcagtttcttttacatgttcatcctcacaaggcagagatcattatctctgctttaaactctagcaccagggtgtcttagctaatgtgaaaaaaaaaaaaagaggtctgcacccaagtctttgcttctcttgtctaggaaaaataattccattctttccagagaaagagtgaatggcattactctctaattcagaaaccctgggtaccatcttggggatggaaggactcccaggcgtctggcagatacctacttgaagaagctcctactgagagaagcccactcatcctggatacaggtgtctgagtatacacctccatggtccagattcaggagtctgtaatgtgaccatgagctttccgggaaaattaaatcatgaatattgactttgtttgatctctatatgattataaaaagctgagggttttttttaagacacattaatccaacacatgaaagatcattaaaagtaatgtacatttttgctcatggggattccattcacaatgtacagcaacacttctgaaaatgctctttctccatctccctacataaacagaagctgcctcacccctggggcacaaccagtagattcggtttaagacagttgttttataggggtagcatccaggtatcaataatttttatagctctctaggagttctaagaaatggattccactggcagccaagattgagagcagtcatctgggggctttagccaatctaccatctctctttgtgctggttacattgggctgaggtttctttccttccactcattccatacacatacttaattatgttagtcttggcagcttcgagcaaacctttaggccatagcttaacatgttatacatcaaaatacactgacatttgttgcaatgaggagctgtttgaaatctcacacttcccactattttttgcaaagcatcttttccttgctgccacaatctgtgttgcactatattaagtagtcaatcttagctacatgttaagtgttttaaatggataataagaaaaaaggaggaagagaagagagtgctgacatattttagggctaagggtctcacttcctcacagtcaagtgctctgtttccagaaggcctacttcccacacttaggctgcaatgcattataccctcctaccaattcaaaacacatgcatcttatgttcctctccctttcatcttgccaaattagcagctaatgaacctgataaattaatcccttacagtgcataataaatgataatgttttaatgagttgttctacccagatagcagttctgcatttttctaaggccttctgaagacacgtatcaatgcaaaggaaggctctaatattggaaagcaggcgctgtgtgaggacagcaaggctgatataaattagaggatcagacagcgcatccttgaagtcacacctcaaatgagatggctgcccactcaaagcaagccctggtgataagtgataattcagtccctcactatagaattgctcagccactgacctcacatttatgagaccacactctgccccatgactatgtatctctttatctgtcagcctctcactattttcagaacatacagcacacactttgtaggtgctcaatgaatatctggttaaaagatagatacatgagtgctcccctccattcctctgttttacacaaacatccctagaccattaattgagcatcatgtttgttaaggatttctagagaaaaatataccacttcctcaatcaagtgtccattccaatgttagatgtagacttttgaaaaaataaagacagctataataattctcaattaacaaaccaatagatttatccacctggaacatcaatcaaattctaaagtagacaaaaatggtctcttcttgagatggaacaatgccaccctcaagctctcatccagaactcatgaactcaaaccaaataaagataataatttaacaagattgatcatgggattcttagaggatagaagagacatagatgtgtatcaccaacaagagaagaaaatagaacaacacagaaaccatgcatgacacacgtggtaactgccctctggctccatccattccacccatcatgtgatcacattctccttgccaacaattgttcagaaatgggcatgtgacctaatctcagccaagcaggggcatgatatagtctactgggggattctcgaaaggctgcctctctcttaagaaagaagtacagtggccaggcacagtggctcacccctgtaatctcagtactttaggaggccaaggcagacggatcacttgaggtcaggagtgcaagaccagcctagtcaatatggtgaaaccccatctctactaaaaatacaaaaattagctgggctgtggtggtgtgtgcctgtaatcccagctactcgggctgctgaagcaggagaatcgcttgaacccgagaggtggaggttgcaatgagctcagatcacaccactgcactccaccctgggagacagagtgagaccctgtctcaaaaaaaaaaaaaaaagaaagaaaagaaaagaaaaaaaagaaagaagcacagtgggccaggcacagtagctcatgcctgtaatcccagcactttgggagaccgagtgcaggcagatcacttgaggtcaggagttcgagatcagcctgggcaacatggcgaaacctcatctctactaaaaatacaaaaattacaggcatggtgcatgcctgtaatcccagctactggggaggctgaggcgggagaatcacttgaactcaggaggtggaggttgtagtgagccaagatcacgccactgcactccagcctgggcaacaaagtaagactccatctcacaaaaaaaaaaggaaagaaagaagcacagtgaaaagacagttgccttccttctctgaacaatgtcttttctgtgaaacctgaaattgttccagccattgcaactaaaaggaagccagcctgagggccaagtcaacacaccaaggatagtagtagagcaaaatgggaaaaacttgtgtcactcctgacaactggggttctgcatcaatagacccaggagctttatttctggacttcttgttttgaggggaaaaaaatgtatttcttcattctataaaccaatttaagttaggatttctataatctataactgaaggcattctaacaaataaaggaagaataaagaaatgaatcaccaggtattaattatattggaaataaacattaaaatggatatgttgattcatctttggtcatactgatttttacactttaaagatgataattgtgtgatttattatagcaacaggataagaagtggtgtgggtcacagtgtctgctctctgtacaggttcttgttaataaatctgaaaatgaacctgttagatgaaagaagaaattaattctgcatatgtgaatagagagcttcctatatgctactagcgtttgacccatcagtcaatacacctcaatcaaaacatggaactttcactcctgatgctctctatcccagcaacacacagttcactccacagtcacaattccctgcagcaagatgaagaaactaagttctctccctccaaagcttcagaggcaatgcatatgtaacagtgcagaaaacagaagtacagagaatttgaggcctgaatctactgctttgccttagaaagtcatctatgttcctgctcttggcacttcacaggaaatgagactataatctattccaagagtttgcattatttttagttcactacccacctcaatctgttcatttttaaaaatttatatgggttttagcatttgctttggaataccattcatattgtaaaaatggaggtgataacctataaataaaacaaccccatttaaaaataggaatgaagcggacagccaattaaagtgttatcatattaaataggattacttttcaaaggatctcagtgtttgcatttttattgattcattacaggaaaaagtatacgtaattttacaatgtttacgctctgagcatagctgccatgaggctctgctttcaaaatgctgcaaaacgctgctgctccttaaatacctattgaaatctgaatccattccctatggctgctataacaaattaccacaaacttcagataacacaaatttattaccttgcagtcctggaggtcaaaagtctgaaatgggtctcactgagctaaaaccaagttattggcagggttgcattccttccagaggcgttggaggagaatcagtttccttgccttttccagcttctagaggctgacagcattccttggctgatggctacatcactccgacctcgctcccatcatcacatcttcttctctaactctgaacctcctacttccctctcataagaaccttgtaattataatgagcccacccaataatccaggataacctacccattccaatttaaagatccttccctttttgtttttttttttttagacagggtcttactctgtcacccaggctggaatacagtggcataatcatggcttattccagccttaaactcctggtgatatggtttgggtgtgccccaacccaaatctcatcttgaattgtagttcccataatccccatgtgtgctgggacggac

SEQ ID NO: 1496 - DNA, 1880 bp, Homo sapiens
caggaggtcagaacaagaaacagttcacaaagaccctcctgataaaacacgatgtggcaaagaagctggctaaaactcaccaaaaccaagatggtgaccaaagtgacctctggccatcctcactgctcattatacactaattataatgtattagtatgctaaaagacacttccaccagccccgtaacagtttacaaatgccatggcagcgtcaggtcaggaagttaccctatatggtctaaacaggggagggacccttagtcccaggaaatccccactcatgaattattcaccccttatttagcatataatcaagaaatcgagatgatcttcttaatgcctctcaaattatttccaaaagtgcctgtctgtgtggaagttcccttcacaggccagggctagtcgggcagcacaaggggccaaggcccatgcctggggtcaggcaggcccagccaggttgcttgccctttacccatgcctctgcctggccctcccatagaggggcagggcaacccaggccaacctagtggcagtatgagctgagtgactgtggccacctgtggaaactggttttgcagcaccagcccctctcttctgtgtcctttcttgcatcttttttttttttttaagaaggagttttgctcttgttgcccaggctggtgtgcaatgacgtgatctcagctcattgcaacctccgcctcccgggttcaagcgattctcctgcctcagcctcctgagtagctgggattacaggtatgtgccaccacgcccgcctaattttttgtatttagtagagacggggtttcaccgtgttggtcaggctggtctcaaactcctgacctcaagtgatctacctgcctcagcctcccaaagtgctgggattacaggcatgagccaacgcgcccagccttatttgtgctgccccaatttctaggaatttatacactctggggaccaacctcatcatgggaataagaattcaattcttcacgaaaatcatttcctccactgacacactttgtacagacataggaatctgacacacctgggtttgcatctggagtctaccatttactggcgaagtaatattgaacaaactttggctctaggagcctcagtttctccacccgtaaagtagaaaacgtcatctgtgcttgcaggcttgttgagaagattaaattaatccagccatttattccacaaatccttattgagtgcctaactgcacctcacattgaggatacagatatgataacatgatagacacagaggtgagtccacttgcaaggcactcagagagatatggaccaacagtgacccccaaatccatgttactgattgtgttgagggacacagaggaaaagtactcaggagtagtggtgtgagctcagttttgaaggataactgggtgcaatctatttcatcgaatctaagactctattgatcatccacactattattttagataacactgagacaaaaattcagccaattaaccttagaaatgttattttgtgcttactgaaagagctcttttgaccttctgcagccccagaggagttttctctctcccacctaatttaaaacaaagaaggatgtgtagtggcagagatcagaatagggtagaatccaagagaaatctaccttgccctgcagcaagctttgctgggtataaaattcctgagtttgtggttggtaggctcctgggctctgactcagtggaaagaagaggtaggacaaaggggttatgtggaccggcctggggagaagtgtggggaaggggtcctggctgagcagtcactactgggctcagtttttggggtggccagaaggagaagaggcaaatgccaagctgggggattgtaagacatcatctctaaa

SEQ ID NO: 1497 - DNA, 2122 bp, Homo sapiens
aaactctattaatggtcaacccttccagaaacagctggatccatgtttacatttttatttttaatagtgatcctcctatagaaaactaaaatagaattgactttttcctccaaaaataatcaaataacatgcagtcatatcacactcagctcaataaaatctagacaactaataaactgaaatttcccatatggtataaggcctatgcaatattgattgcgtatcaccacaattaagtgttaatagaaaatattttccatgacatcatactataaacaataactcttcccttccaatggacaatttgacattagcaaaaaatatttatgattcacaaaagattaacacatcaaatactgacatatatgacagcaaccacaactttttgtctctcaaagaaaaatgtgttccataagctttcaagatatattttagtcactgagaaaatgcatgataaacaactgtagcctcagaataatacacaataaacgtgattaagagggcttaccagtagaaagtgaaattggcaagaaataggggcagcatttattttcactttatgtatgtacaatatttaagtttgccacagtgaaggtgcatcattttggtaattttattttaaacttaaatctgaagcaggggaaacagctgcagtctctgagaagcttaacactcaaataatgaaaccatcttctctgacagcaggttatgaattcacaaatacaacacaatacatcgaccagttataaaacataaatgttgacttcaattggaatgagtcacaaagtctatattaagccctggaaacaaacatcatgtggccttcagaagaccttcttaattccaacaatgttattattaagtttcactttggacatttttttcttaatcaggactatacacacccataagaaatttgagatgcccttcgtgcaattatgagacaatcttactttgacagcaaattacacaaagcacaaaacaaggtgtaacatcacaacttgatgtaaggaactggcacatgaacaattcaactgagtgtacaattatgtgggcacaattttctgggtttagacaatataaaaggctgtgtcctcatgagctgggcagaggggatagctgggtaaactagcatgttttatacagcaattacaccaatgagctgggcaccagtgaggagtgacatccagttgcactttatgtgatatggagtcattcttgatgcatggcaataattatgtgaaagagtttgagctctctctgaattcagctaactgctaactttttactcagtggctacattttaaatacaaagtaaaactgtagactatatatagataatacttactagttttatttgctatgtgaaagaaatccaaataaaatgataactgtttattatgggttctcttgtcacgtggtgaaaggtgaaacaataaatgtaatgtgcactatgcaaattggtactattaaaccccaaattgaaaccatcctaactatctaatagtttcaaaaaacagcatgacagtacagctggatatgaccatggctcactcagctttacagggacctcagtagaatattaaggatatctgaatttagatcaaatcctgtttagaagtaatataatttggtggtgtccccacccagatctcatcttgaattgtaactcccacaattcccacgtgtcatgggagaaacccagtggcaggtgattgaattatgggggcgggtctttcctgcactattcccgtgatatttttaacatcacgaatattttaaataaaatattttaaataaaataagaatattttaaataaaattgttttagaaacgggagtttccctgcacaagctctctctttttgcctgctgtcatccatgtaagacctggctttctcctccttgcctttcgtcatgattgtgaggcctccccagccatgtggaactgtaagtccattaaacctctttcttttgtaaattgcccagttcgtatgtctttatcagcagcataaaaataaactaatacaacaagcatgttcacaagatgtatatctatatagcaagtgaaagaagcctcaggcaacagttgaaaaacttagtcaaatcttgtgcattagaaa

SEQ ID NO: 1498 - DNA, 1806 bp, Homo sapiens
gtactgtgtgaactactgcaattaactaagaaaagcaccaatctgttaatctcagaaaagtcctttttttgaagtatgtgatgttttagatattttagactggtacaatgtaaattgaaggtgcccttggtacatccgaaaaaatctagaactttatgcaaaaaaaaaatatatcttgatattccacattagataccacattgccacacattaattggaaagacgttgtctacttcagcagaagacaggcattgtatcttcacctttccaaggctcttcacaaaaaacttaataccaaaaacacaaaagaaaagtatttttatgtagccaagtgtttattcatatttttaaaataagcaaatttcactacaagagaaattttcaaataccctattttcaaaaagatcaacttagttgatctttttatctcctagcacattcagccaataaattcaaactccaaaatgaactcaacatatctatgtaaggaactgtaaacaaattaacaactggagaaaaattatctacttttactaggaaactttcaatttgaataaaatatattaagagaaaatcttgctaactttccttgaaaaaaaggtattatgagaaataaataaatgaataaatacactcctgaagttgacaaatttgcaacagtttagtgaccattaacggtttcctcctaaaaagaaaaacaataaaaagaaatgaacactatatagactgtatttttttaccttaattccaccaaggatagtgatttaataaaaataaatcactgaacagtgagtgtcaacaatatgactttgagataataaagattgggaattaggagtattttcaagtggaaccatatcagacaaaaacagacagcaaagaggtctttgtagcaattgtaattacacacatgtgagatgacctgaaaatggggagtgctacaaaaccactgtgaaagaattctttacttctcaaatatcatttcataaaaactacagaaaaatcagagccagtaaaacttaaattatctttcaaatagtcatcataaactctaacctagttaaaacaaatgttgactgtaatatgctaatactgtaatataaatccctaaatataaataccaaataaatatacctaaatataaatataccaaatataagtacccaaaattcatgaacattttataagagctacaagaacacacttttagacaaaatgggacataccacccaaaaggttaaactctactaaacttcactgtgattatgaccagcctacccatcctctacatgtgaaataaaactttttattaaaaaagagatctcaccacttcttgtttctgggcttcattaagtttttcagtcaattcttccaaagccctttttgtttcggcatctgacctaggaagaaaaaaaaaaaaaagatttaaatttggatatttagaaaatacacagaacgagtgaaatgtataacatgataattatgttattacaaaatattctactttagtgattctcaaatgttataaacatctgaaacacgtggaaggcttgttaaaacacagactgctggatcccgccccccagatttcaaatcagcaaatctgagatgaggcccaagaatgtgcctttctaaaattcctaagtgatgcagaaacagaggtctgcaggtctggagaccaaactttgagaaccgctgctacgctggaacatcactctcaataaacacacaggttgcaatatctcccattttaaattaagaaaaaagagagaaagggacaaaagaaaacaaaaactcttgatctta

SEQ ID NO: 1499 - DNA, 1870 bp, Homo sapiens
actcacacatacactcacacacatattttggctgtgtcttcattatctcagtagactaaataagatattttaggcaaatatttagaaatgttataaccagagtgctaaacatgattaagtgtaattctcacttaatgaaacatttctagacattaccctattcgtacccttatcttagctctgaatattcactaacatattcaaatatcttctcattctgtatcagcccccatattcgctttatggtctagtatcttcttccttcatttgacatttatcaacatgctgctgatgctattttatttttctctgttcttccagcaatttttagtatcagcctctatctgcagtaaagaacaaagctgcagtggaaatgacagcttccctagaagccatctaagtaccttcctatgctctgggtttttttgttctttttagaaaattagagaacacaaaacatgggctatacctgacaagattctgagttgaactcatttttggtagatgtcatgctgtggctgacagctttgcagccagaagagtgattttggacaagggaagggagaatgggacagtattgcagcatttaatattttatttgcaaccacgttgatttttttaaaagaaatatcttgtgttataacaaagattattgttatttttgttgaaaaaccatgaacttaaagggacactagttttatgaaaatgaaatgaatcagtttagtattaaagagtggacagtttatgtgtgcttataattatggaaagacttagagatgagtataaaaagtggaaaagtaaagaaaactgcatatttattgagtattcttaaaaaccttttggaagcagtgtagctaaaagaaaggaactatgtttctagaactattgtgagaactagggaagccaaagtctataaaatcatattttcataatggatgactggatgcagaaaaacctcatattttcaaagaaacattgatttctaaagataagaatatttgtgattttatattatgcatttatttgagaaactcatttacataggacaaacctcctcttcctgtacatatggcagcccagcaattattactggtaagatgtaggttacttggacagcttaagcttgttttttcatcaacaaatagaaaagataaatctatttatacaagatagcagtcatgagaaaaacaaaattgattgaatcagatcaattgttttcatatgcaagaaataaataattttaaactaaaaactgcatttatttctgttgattggcaccagttgaaaatcagtgcgatggagtcatttggtactccatgctgttctacatgacccacattatttggttaattttctgcttcaggaacattatatagtcaccaccaaggcaggccaggcagagtcaggaaagcataatttatgcagcctaccaaaatgctattgaggttatacttatttaaaaatacttaagcattattagaatgggaaatctaaaagtcaggagtgaaatagtatattgtatatagtttgatatttaatagttacacagagggaagtacaaatagcaatttattcttgtttttagtccctcatatttacattctatttctgtatcccccagtgaactggggtaagattgattgtgctcttctctaatccttaagcattatatactggatggctgagagttgtactgagtactgaaattatgccaatataagtataatattgccttttacttttcaacaacttgagttgctccatgaaaggagcaatttacccaaatacctgagcgagcatctggagacatgtcttttatttacaatttgactaccagacaagtcattaagaatttcagaatttgctagct

SEQ ID NO: 1500 - DNA, 3230 bp, Homo sapiens
aatgtagatccttgagctccatccctgatcttgtagatcagaatttccagagctatggcccagggaggtatcatgttcaaaactcccccagtgactctgtgcagctgcccacaggcagcagtgggcgatgaatgttagtgaagtgctacgagtggccgggagaggtgaggatggagctttgggcaagactacctacctgattctgctactcatgatcctcagtaacctgcagcccagaagagggccttggagaccctctggacaggaacacacaaacccttcccccaggcaaagagtgcagcacctcaaaggctgtcatcgtcacatatgatcaaggtcacttaataaatgagtattgagggtttctaatatttggtgttcataaggtaaaaggagccaacattggaatttactgaggacttgaacacagtgttctacttagaagcctggctgccatctggctcttggcaacagaggtggctgggaatcctgcaatttgggggaaggctacgcattgctggcatcccgttagtgctgtctcaagtcggctatgcttttcagtcattgctcttcttgctccttggctgtatgttacagtgaattcagcttcacccatctccatggtgtttgtcgggggttgtttggttaactctgcagtgtgtagtgatgcccattttgcatcaaccatctggggagtctataattttccaatgactagactctagtgtcatagatactatgattcccatgggaacctccacgtgctggctgcaaaggcggatgcatgcatgcacctctggcttccccaaatttgctttatggcagcatttcctattatcacacagtaccttttccatggaaaattgggactggatgaggcagtagaccatgaggtcttttgtcctgctccagtgggttacccatcaacaaagtttgagagccattggcttagaggcagcaactctcagagctgggagaagccccagacccaacgtcaaggagcctctgaatgtgctacagtttctttaatcagctggaggtagtttcctccaatttttaagactatggcccagtacatgggcagtggctgccttgaggggctgtccaataatgtgatatttcatttacagcagtaaaggagcatagcttgtgaatgttaatattggattatttcccctcatagttagctgcctcctcacttcactgtttccatggcaacacttctcaaacaccacttcatactctgaatacacaatgtaaacaatctgcagttgaacatttcccaatttaggggtttggagcccaagtcagcaggcctgccgttcggaagctgctgagaagcgggaggctggcggaactcacagcaaggactgccagagccagcctgggctggagggcaaaaggtcactccctgagtattctgctttttctttagggggcatttagtacaggaggggcttggagtgacttatagaactgggaggggctccccgatcacttagagatgaggagcttcaagctccaagaagtgaagtgactttcccattgtcacacaggtttgtgatggagccaagaccagaacgagggcttgtccaggcactacaaatgctcacccagtgtgtgctcctgagcatccccacccagcacccccacctcccaccccatggtcatgggtattccttcccattgagtctagagactgaatcatacttctcaatttcaacacaacatctgtcagcccatatggacaccactgactggctgcaagggcctcaactgggcctgcatgcaggcagctccatgggccctggtatctctactaaggaaagcagggactcagcttactgtcctgggagcagctccagacccccactaaaggcatcattattttctttttatcaaaggaactatttttatttccagtgtctccccacacagagtaatgcatgcaatttccacatggttataagcaaagcaaggagattgttgctttgtttttgttgttttttttttaataggaaaacctcagacgatttccttttaacttcttagcaatccttagcatcctttgacttctgagcaaacaatcatatggttgctgtgtctttagcaatgagccaaaggacactcatgacctagggaagttaaaaagagactcagagagtgtttgagaaaatgcgaccagcaggtgccctatggggatgggctgttgggaggtgctggggaggggatatccgtttagctgctgactgggctttggagtgagggaggatggagtccatcctttgaagattttaaacagacagcttttgagcacagtgtatccctaatacaatgggggcagagcttctatctctctgccgatatcctggggactcagtgtgtattgcactcacacccatcagagccctttctgctcctattcatttggtttgggttggtcacaaaggtgtgtgcctactgtgtgtcctcctaggcatggcccattgggtctccccactgatgccaggtaagatcaccagaaacgtaagagtgtccctgagagccaggtctagactccagctcccattctataacccatgctgggctggtcctgctgggccttcatcatgagcaccccaggccctcagagtattacccgtgggacaaaatccacaggcacatcagggctctgatgagctgatgagggtgttgagtattaaaccgggaccactgacaatgcccccaccctaagtgaatcagacatagctatttctgtcttctgttctccagattgccccccatccccaaagaagatgcttttactgaggcaattttgccagatagagctatgagccagaagaccaggctttcaggtctggctctatcactaactcactgggaccgtgggaaagtcaagccccttttcttggcctcagtttccccatatgcaaaatgcagggattaggctatatcaatatttctcaaaacaccagttctatggggatattaactggtgatgggagcaaaaagtattccagggtgaaataagttccagaaatgctgaattccacaaaataatagatgttgcattgtgtatcttcccagagccaataatatgccttgcaggcctccgaaaggggattatagcatacaatatttccaaaatgtatttaaccacagggcctctaaactcttccagtatcagcattggaattctcttgctttccttggagaagcaacaagaaatt

SEQ ID NO: 1501 - DNA, 1827 bp, Homo sapiens
gcctgtaatctcagcactttgggaggccgaggcaggtggatcacctgaggtcaggggttcgaaaccagcctggccaacatggcaaaaccccatctctactaaaatatgaaattagctgggcatggtggtgcatgcctataatcccagctacttgggaagctgagacaggggaatcgcttgaacctggaaggtggaggttgcagtgagccgagaatgtgccattgcactctggccaggtcaacaggagcgaaactctgtctcaataaataaataaataaacacaaattatagatgaaaaatggattattccattatttctaactttatgctatatacccaaacaaattccacataaagattacgatgtaaaaaaaaacctttgtgttgaaaatgtaaaaaacataaagaataaagaacatataaatatttacgtaatcttggcctggggaagagctttctaagtataaaatcaaaggcaaatgcatagaagaaaagagtaatcgatttgaccacatataaattgagccacctgacatcagaaacactgtaaataaaactaaatgtcaaaccactatgagaaaatattatttgcagcatgtattgtagaacaaggattaatatccttcatgcatagtgttatgaattgagaagaaaaaggcaaatagtgtaataaaaatggtcaaaggacatacaatctgacactttaattattttagttttgtatttcaacaatttacaaaacaagtaataaatatagtggccaaaaacataggaaacgtatccaacatcactaaaaatcaaagaaatgcaaagcaaatcaaagtataattttttcctgtcaaactgaaaacaaaatttaaaatcataaccttcagtgttattgagatttaggaactggcatttccatggcctgctggtgtcagtgtaagttgatcgagcctttctggaagacaatggaagaatgcatatcaaaagccttcaggacagttgtttatttgttgcctctcatcttcatacctcctgcccacaccatttctgttcggtaatgcaggggctagaagtctgcaaacttcattttccagataccttgctggcttccagtttgctaatgggaggcaatggtggagattgaatggtgagaggaggggagaagggactctgttttgatttctgactgaggtctgcatccctccagcagcagccatgccacctgcaccccaagcaccaggcatgtggtgctgcctcagaggtcagtgccctcctctcagatgtctgagcgtggccgcaggcgccccctgagagttccaagcacagatcttgcagtgtcctgccctgaaggtctgagcatgagccttagggagcctcctccttcacatgcctaagttctggacgctccatgtctttttttcttttttcccccaaacctgggaatggcagctccttcttgcaattattaatctctgggttacctcttcatcttttgctttctatcttgtctcttctctctctctgtctctcacccaggctggagtgtagtgatgtgatcttggctcactgcagcctcggcttcccaggctcaggtgatcctctcgcctcctgagtagctgggactacaggcaagcgccaccacacctgactaattttgttttaaattattattatttttagtagagactgggtttcactatgttgcccaggctggtctcaaactcctgtactcaagcaattcgcctgctttggcctcccagagttctgggattacaggtgtgagccacgacacccagcctactttgcatcttctcaacacctgcacagtcaattccgtat

SEQ ID NO: 1502 - DNA, 1969 bp, Homo sapiens
tgatttacggatttcctctatacttagtttacaaaaaacagcaggagatgaatgaaaaaaagacaagaaaaaaacaatttccagctctgtcctgaagcctgtgctgcatttaaaaaaatgcaaaattcaagttattggttcattttgaaaagtccatgttgaaaaggagccagagtagggcacgattgatgcgatttgcgacacataatatcaactattgggttaaaaaataaatgtagctgctacattaacagcaatattgtaatctaacacctaattttctgacaattctctaatacatagaccacgtccaatttaagaaaacctaagataaaaatatatgtatatatcatgtgcattttactataattagatgactcttttatgggggagtttttcttgataacaccaaataacccacacccttcttcacctaggaagttacaaatgcagaaaaaaagaggttctgtagtctcccttagttaccattctgttcaaaatatgtccccacctaatataacttgctatgtgtcataaaatacaaaggaaagtacttttcatgccaaatatcagagaagtgctctcttttctatactgcacaagtaacagaaatgatgtgttcattttaaattccattcatgtaggttctaataaaagctattataaaatacaattgtgtggagacaaaaagagagataatatcactatagctcaatataaaatttaagtaattaagacatgaaaactattacacaatttactacaaatgcagcaagaataataaaatgtttaacccttttccttctgattcctctcctgatctcactctttctctttaatgcctaatggaaaaacacgagtacctcagagaaagcacagaaatattacgatgcagactgtttggggaatgcataatgttgataataaaaggaaaatgacttgtttttcttttctttcaggtaagaggtgttgcatttctggagtgatgtactctctactgtgtacctctaaggcaaattgattttatctagagaaaatatgaaattgcctatctataatcagcctcacaatgacatgattaaccagtaaaagaccatgatgacaagtgtagaaggtcctgtgggtccgtggccagaatttgagctggggtcagagggatcagagttcaaatcttgaccctgctgcctgccacctttgtgacattggacaactttgttcagattcactgttctcatctgttgaatggacatcattatatttgcttctcttagcttttacggctgcccttcagtcaggcaatagaggtactcagtctccataattagtgcaatgggatattcaaacttcatgcataaaatggaaaaagtacaaagaactatgattctctattttgattttccctgaacagtggcatatatctgtctgagatcattgcaagttgcaccaggatgtgaacaccgtcagtagggatgtgctatttctttgtcaatgttttccccacttttttgattttattaaagagaaaagatctacatggtgccagtaggtctctatcacttttctagcacttgttaagtttcactttttaataaagagggtgaggtcttgagcttggagcctgcttaagggagtggagtctcaggagaataagatgatatctttttaattgtattttttctatttttaatttttaattttatttcaataggtttttggggaacgggtggtatttggttacatgagtaagttctttagtggtgatttcggagattttggtgcacccatcaccgagcagtgtaccctgaacctaatgtgtagtcttttaacccttgtcacccccaaccctttcacccgaatccccaaagtccagtgtattattcttatgcttttgtgtcctcatagcttagctcccacatatgagtgagaacatacaatgtttggttttccattcctgagttacatgacgtag

SEQ ID NO: 1503 - DNA, 2623 bp, Homo sapiens
atctgtacacagtaaattgtgttaagctactaaatttgtagttgttttttatgaagcaatagaaaacgaatgcaaggatattggtgaaagagatggaatttgctgattataggaagaggagaaaatttcaggcaaagggaatgcatatgcaaaggcaaagtagcaagaacatatatcgtttatttcaagaatggtattgattcaggcattcctagagcaacaagaagagtggcaagtggaagataagagagcaactcaaagaggagtcaaaaggcactaatctcaaagccagtttttctttaacatggcctcatctccaattcacctaggaaacctgtgtcaatcaaaatctatggtgccacccacagcaattcttcttcagggtgtgtggaatgaggcagagatagttgtagttctgataaatgtcccaggtgagtctgatgcagccagtccatgaaataggagttgtggatcacttctgcatcaaacagttccccacaagaggtcgcgcagtagaagagtgacataaaacatttattttctgtatgcctaatccagaagcagtttggaggatggcctagtgtgggaagaggggttggagactacactccatgggttaccttggagaccattgcaatgacagcaatctgaccagggggtggcccttggcagaatcagtggtgagtcagatgtacgcagtcaaggaaagagagatgcagagaagaaaagaaaggaggaaaaaaggggaagaaggaagggatgagagggtgccggagaaggacggcagatttgtcggggggagatgataaagtactctgttttcaagagctgagttttgcaagtgcagtcttttctgaccctcatttctgctaactgggtctccagagctttgcatattgactctggctctctttccattggatcagccaagtgtccagactccaggtttctggaacatgtgaccttctccacatggaggccatttacagaagaaactgctaagcctcactaatcccagctactaggacggcactctttggccatttcagacctgcaattacttctgcacttaagtccatagatagatggtggagtcaggacaagtttgaggaatgctggcccttcccctatgagttgttggtctaaaggcggacccctggaccctgcctttgagactgattgagctgcacactgggaaattgcgtatttgtttattcagttaacatttgctgaatacatactgaatgcccagtgctgttctgggctctgaggctacagcattgaacaagacaggcgtgtgctaattccaccttttcttgcctgtgagacccccccagaagtcaaagatgttagagtctccaggggcaggagagacgggaagaggtggaactattgccttccgggcttacacagtctctgttccttcaaaactgtctttcctactagggatgttttccaaagtgggttctctggaacccctgtttctatggggtataaagaaaagtcagacctgcaaaaaggagttcaataatagtcaatgttatccatgtaacattcactgcatgccacgcactaagcacattatgatattaatctgtctgatcccaccagctagtatgatccttattttagacccagggaaatggaggcatgaagtatgaagttgctgccaaagctcatagagctagtcagtaagaaagctgatattcaactcctgtggtcagaaccgagtatctgaactttcaccactgcacatcaccagttccacatggtcaaagaagccaagaaaactctaggttaaaaaaaaaaaagaaaaaaaactctaggtttaaaaaaaaaaaaattccaagtcaagcatgttcctgctaagcatgttttcatgtgcttattggccattcagtagtcttcttttgtgaagtatctgtttgatattttgtgcattttcattgggttgtgtgtctttttactattgatttgtgggatatttttatatatcctagtaatcagtcttttgtagctatcatacgtattgcaaatattttctcccagtgcatagcttgcctttttattttcttgatgagcagaagtatttcattttgatgaaatgcaatttatcagtgttttcttctatagttagcattttctgtgttctgttaaagctatacttttttttctgtcccaaggtcataaaaatattctgcttttttaaaaattgttttaccttttatatttagagatataatcattcttcaattatttttcatatatgacataagatgaggatacaggtatgttatttttcatatgaatatttggttgttccagtaccattttttaaaaagaattttctctgccgagctgctttgctacctctgttaaaaatcagttggccatgtaagtgtgcatctgtttctggcctctctattctgtttcatttctacaccatcctgccaataccataccattttgattactgtagctttgttttttcttttttcttcttcttttttttttttttagacagagtcttgctcttgttgcccaggctggagtgcagtggcgtaatcttggctcactgcaacctccaccttcccaggttcaagagattctcctgactcagcct

SEQ ID NO: 1504 - DNA, 2228 bp, Homo sapiens
atccacacaaaatgaaatatttttaatgaagtctaagttacagttctagaaggtactaaacatgcctttcgcagctccattcattcatgcatctgagaaccacagaaagagcctagtgtctcctcctggaatacagaccctcgtgttagttggaagggatgcttatgaggatcagaactggatgctgtggagatcccagcccaggcaattggttcaagcctcctttggggaggttcatgctcctgtgttcccttctagcgtcttccatcaggcattcattccttattccaaatcatatgcaaagcacctagttggtgcaaggcaatgggctgggctgtggggatcccaaaatagatgtgatcaattcttgccctggagatactgacagccaacagcagatgcctccaactccactgagtagaatacaagcacccagtggcatgttggagtcacctgtgggagctttgggggtctggggccctgggaaacacacacatacagtcttcttactcagaggccttcaaagatttttttatatgcctgattgtgatttttttaattttttttttcatagattcagtgcctaccatgtggtaggcatggtgttgggtgtgcctcggctgtttgctcatagactcaggggactaaggctcaaagacatgagtaaactcctcaagacacagaacacatacgtggctgaccaggctccagcgcagcgcttcaggctccaaacccagggatggtctctttcccataccacagaatgcatgagaggatgaatcttgaggatctttaaatgcctgctgacttccaggcttcagatgaataaacacatgtgcagagcgtgtgtcggagaggatgcaggaactggctaagcgagccgatcactttacttgcaagataggaacctagggtccagggaggggaactgacctacccagggcacccagcacagagctaagcctggaatccaggtcttctgtctcccaggacaccatgcacagctccacgccacctgtatgtcctcccttcccacgcctccctcatcctccgcatgacacgtggataccaagtcaaaaaccatcctaatgaagttgctgtaaatattttccactcagtttgcaggttagcaagattttttttctgcctcgcagttttagacaatttacgcttccattctcaaaacagatttttatcctaataaaggcttttattactattattcacctgtcattacacagcattagacaattacagagcgcagactgactctcccaccacgaaccttcccctccgctctcagtggggggagggggtgcacacaaacagaacatttcactaaaaaatagagagaaatctttaatttttaagcgctgccaagcctgctacctacgctttttaaaactttgttgtgaaaagtcactggcgtgagcgagagggagataataaagaagtgtgggctagaaaccatctccagccccattttgattgccagacgattgacaaaataatttgtacccgtcgatgctcatgaagggaatttttacaatggatttgccaagcagatttttaattttaatcagtaatgaaaaaatgacaacatggatcacaacaagacatcagttgctgaacgggctttgcagtccctgtcaggcagcctctgtcaggaagccgcacctccgtgagcatcaatcactcgtttcaaactcctgtacatcttcaggatttaattagacatttaagttctttacccgcaatttgcaaaactgtcacttaccaaaagtgcaagacgctaaaaaatattccgcgtgagtcctgtgggactgtttatctccttcctgggagaggattagaagttaatatttggacacacaccctccgaccaaaaaatattatatatattatatatatatatatatatatatacacacatatatacatcctcactcagctactatgcctgacccacagctacagatattttcaaagagcaaaaaagtaaaagatcaatgattgtggtgaaaaccaaccccaaactctccgtggaaggacaagaggaagagagtgggtgagacggaggtttattctttttgtcaagaacttattctaagacggtcttgatcttactgacttgctgtggtctggaaagcagaactttagagaaatgttgacggacatgaccttgagccaattggctttgcctctcccagccttcatttcctaccaac

SEQ ID NO: 1505 - DNA, 2953 bp, Homo sapiens
acagctggtaagaggcagagctgggatttgaactcagaactgcctggctgcaaggccagagttccttctagaacccctctaggggtctgcacttcctttagcacatggccaattgaccacctgcccacaaaaaatggcctggccctggtggctagggcaccctcctgcagatggaggcaaggagcagtagggagtggggctgggcatcagttgcccaggtacttcctagctctatgccctgggcaagtgaagtcctcctttctgaccctccctgcacccactggtgactggtggcagaataccctcctgggttattgttaggatcacagacaacatgtgtgaggcacctggcacttggtgggcactcaggaagtgaaggaccctgccctttggcatctgttgcttgtcagaatgcgtggtggatggctctggcctcggtgacgaagctgctgttgcttcagcccccggactcctgtgcatcacagagctgattcagtgcagacaggtgactcatctgatggcattttgtgtggcgttgtgcagttcagcctggtacagcacggcccgcccacagcaggtattcaagagccgttagtgtttatgaaggtgataaaattgcctagatggagggaagccgtcaaaataagagcctttgcctgtcttgtgaaagttaacttgcaaacctaatgcctgtggggctgctgaaaaagcgtcacctggatttctccttggagacagaactctctggaaggacagctgggcagcccctgcttgccatgtgggggtggacgctttttatgtgacagtgagttggagaaactaacagtggtcttcaaggcattgtgctcagcttaactctttgaattgccatagctttaaaatgaatactagaaacagttatatatttttcacactctccatattttctccattcaatataataaatgttatcttgaatgtttgagggttttatagcaaaaattcctcccatttgtaaagcatgctgcagtggatgggagtgaactagctggcagcgctctcgtgtgacgtggcagaggctgagggagttgcccaaaccccacttccagttggaggaagcctgggccctgacttccagtgcatgttcaggtccacttgtcaaggaaaggatccattgttaagaaacaaacatgggaaactgtcatgtgagcgtccctaaaagcagcatagtcattttcgagtcactctctgataaagatagaacacttcatttaggcacatttcaggatttcagaacatttggagtagtcctggggtggaaagcagcgttttcctttttcaatttcaacctgactccattcctctctttatgtgtgtcagtcatagcaggggagtgttttcctcttggatgcgtttgcacctggcaaatgaatgtgcaggaattctttgattgcaaaatagctactctcaaaatgcagacaggcagccacagtcagggagcccttcggccacggcagcggggtggcgccagacacctggctttgagtcccgtggaggcatgccacttagtctgttctgagcggctgtttacaggcggatagaaagggctgtaggatgggaccctcaaggttttggggcatgggaggggctggccgtcatgattcagcatgctagctctctggaggctgtgctgagcactgagggacactgggagaaaaacacaggctcctgctttgtccatgtggaaggagcccaggctgccctggctgctatacgcatccttccaggcaaccttcaccttctggtctatttagtctcattccctgtttttattcccttcttttatttagggagagccagagcagcaattctcaggtcaggattatttgggagatccatattacttctgattatttacgaagggacaggccgggggaggtaaccacctcgataaattcgtcagcgaggcagctggagggatgtgtgacaaacataccaggctgtcatttggccagagattgtctgcactgggattgttcccccaggatagtcctgatgacaaatgtaattgacattttttattaaccctgaaatgattaaagatgctgctgctgaatttgtgtcaaagtacccggtccctggcattttgagaaagggattctctgtggagccaataaacagcctgtgttttcttcctgttcatcactttaatcaactaagacatacagagccctgtctggtttggtcttgaaactgggccagggagataagactctgcttcctggcttaggtttccagaacactctggtatggacatcatgagggacacataggaggcactctgttcatttaccacacagtcatcaaacgtttgctgagctccttctgtgtgccaggtcctgtgtgtgatattgggcgctgtctccttgaagggtggtcgctgtagaatgggggctagaaagatgtttatggggatgattgtgagaactgagcattgtaggggaagactgggccaccctcactgcctagggggtggggtggggcagggaaggcagtgcagggggtggtttgcgtcttacaggaagggagtctcctctccagacaggtcttacctctggagctctccaggcagatgctggaagtggcagtgcccagagtgtgtgggtcttggagtgccagagtgtgggaacacagaggggcagcaggggagggtggaagacacacaggagagcttggctggggcctgcagatgggctgggggccacatggagcgcaggtggactttgctgcttcctagcctgcctgctgagttactgaagctcttggtcttggtttccttatctgtgaaatgggacaatcctactttcgcttctgtcatagggctgctgcaggatgaaatgacagtaggaggaaagcccctgattggtgcttggcatacagagcctagtcaacaagcatcggttccttcctagat

SEQ ID NO: 1506 - DNA, 3413 bp, Homo sapiens
atcaagtcaataatcaagtcaataattggaagaatgaaataaaataaacacagtaagaatagcagcgtacatttcacctagggtagctggagtttctgcaactttggcttcagttatacctatcacgtgtgagtgagtgtgtgtgcatatgtgtatgtgggagtgtatgtgtgagcatgtgtatgtgtgtgtaccaggtggttgaaatgaagcgtatttctcctgagggatcaaaaatgtttgcaagccaccacctgatcatccccattcctccctcaaccaggacagcccctggtgactgttgggtgcgtttctctccagattctatttcacatattgaccatccaatatgtaatattctcagatgagaacaagcacattctcaaacatattttccctaattgcaatcatgccacatagtgtttgatgacaccaccacccccccacccacacacacacacatacgtactctgttctcatgccgttcctaccctggccccctcacctgtcaatccatctaatctgagcaggtctgcacctgtaggttgatttgtgcctggcaccatctggatggctgaggccccttgaggaatgctgggatcagtggggaacagagtgaggagacagccattgctggtgtcgcagttgccatcaccctcacaattagtatcttttcaaggtccagtgtggccttagcagatggtttagccttgagcaaggagagagaggaggggcattaaaagagttcatagaaagggtcttatttgcccctcgaaggcacaggtggctccccaggacggcatagatagaaggaagggcatccctggcagagggcactgccagtgcaaagccctggaggcctgaaggtgtatgtcatgttcagaaagcaaggagtcctcagtgcggctacaaagcaggagggtgacaagggcaatgaagaaggggagaggcagaaaggggcccagccagcttgagaagagctttaggcaccagcttgcaactctgctgagcctttggggacagaagcctctgacagtaaggtggggcaggcagtcagatggggaggagccatgggaggcctgaggatggggctgggggcacatccatctacccaccccgatgggggtgggcaggtgcactttcagggctcaggctggcatctccaccttccatccagcaactctcctctaggaacttacctggagggaataaccaaactggtgagcaaaggggtgaagaggtaccaggaggtccatggccccctctgatccacctgcaggggagcaagaagagcagggagtgacattggggcacttgctccgggggccaggggccaggcaagtgaattatcaggacgacctgatttggtcatcctaacactcctcttacatgaatatgaccactcaccccatttcatcgacgaagacactgaggctcagcatgtttggagtgagctgggcaaggcatcatggtctgacctgtgttcctccaaagactttgttccccaaaagtctttgttcccccaaaagacatgttgaagtccgcatttttgaggaaatgcgggttgtttggagatagggcctggaaagaggtgagtacattgaaatgaggtcattagggtgggccctgatccaatatgactagtgtccctaaagaagagatcaggatacagacacacaaaggaaagaccatataaggacacagtaagaaggtggccatctacaagccaagacagacctcaatagaaaccatcctggctgacatctcggtcttggatttccagcctccagaactgtaagaaaattaatttcttttgttcaagccgcccatctgcggtatgttgctatagcatgccccagcaaaccaatacgcaaggtcatgtactacaaagtgtttttgaccataggcccgtctgaccccagtgtctgggggtttcacttcaggctccccagcatcccttgcagaggctaaaacaactcaggacactgagattttgcagtctagagtgacaggaaaactcagcttataggacaacaggcctgaaccggggcagtgagtgtgtgctcttttataaatatctgcagagacgctcacacacatacagctctagaaaaatctaccccgaggtattcgcagtagttgtctttgtgtgggtgggattatgagtgttttcttactttcttcttgttgcttctctgtagcctgtgatttttctgtagtgaatgtgtattcctcttatggcagaaaaataaaacgcaaaacagcaaaaacagtggctttggtaagtggaatcctggaggcggggaggccaggccatgaggcagacagaggttctggctggagatggtgggttctgggctaggccttgggtaggagatagagaggtggagccgggggaaggggagaaggagcagggcagtgctatggcagtgaaaggcttgggggcactgggggcatggcaggggtaggcctgctgaataaagtacaggacacccagttaaatctgaatttcagataaacaattaatacaaaatgtttttagtataagtatatcccatgcaagatctgggacacacttgtgctaaacaatgatttgtttttcatctgaaattcacattcagctggacagtctggattgtttgtttatttttctaaatataacagccctgagcggaggaagagtggacaatggtataatctgaggccctgggaggagcggtctcagagctcaaaggatgggttgagaacaatgaaaccatggtccctgaggtcttcggttccaatttccagaaatagttgaatgcctgtggccagacagaggcccccagactctccagagactgcatctgatgacctggggctaaggaagaaatgactatcagcacagccagctacataagctgcagggctcagtgcaaaatgaaaatgtggggtccctgttcaaaaagcaggggagggtgccactaaagctaccccatataaagccttttcctttcttccatggcatctcaactcgtcatggtgtttatttgctatataattcattacaaataaagaaaaagtaacattttaaattatgtgttagtctgggttattcagtgaaacagagctaataggagatagatagacagattgattgattgattgatttcgatttactgcaaggaattggctcataaatatgaccccaaaagcacaggcaacaaaagcaaaaatagacaaaggagattgcatcaaactaaaaggcaaaagaaacaatcaacagagggaggaggcaacctaaggaacgggagaaaatatctgcaaaccatgcatctgatgaggggtttatctctgaaatagacaagaaacacaaacaagtcaatagcgacaaaacaaataaccccagttaaagaaagggcaaaggctgaagg

SEQ ID NO: 1507 - DNA, 1519 bp, Homo sapiens
atatataattatctatttggaagatttaattttatggttacatcagtaatccagtaattaaaattattttctgtaatatatagtgtgtagatttgaagataagtcttaagttcaccatgtgaactgacatacttaccagttaaaattccttacatgctgtttagaacctctaggtgctgaactttttggttagatttcatatttggttgatggtgatatagtgatatgtcttagtgaagagaactagcaatttttatggcttccagttttccccagttcatgtaaaacattgtgttgttaatcatgtaggataaagagacagcaagaaaataagaatagtcaattttaaggttgagctggtcctcatgccgtttttggatttttgctttgttgtatgtagtttgttgatttgccttaaattatccgtgatggatttccttcttattctgttgctgatgcaaaggtgcgagagccacacagctgggaacatttctgctgtttggtttcctgtctgccctttggcagtgtacgcggaggcaggacttgatttgtgctgggtctgcttcagccagtgacctaaaaatgtcagcttgtgttttgcgttacatggagaaggggctatggtatagacagtaccgttaggacttctggcattttttcttgtaaaatttctgtctttaagtagcagtcttcaaaatgcatgtaatcaagtaatgtaagccaatattgtctaagtaacagggcttgtttagcggcatgtgagccagggcttgaagtcttttagcaaaacgaacgtggctgcagcctttttcgtctttctaaaagaatctttgtcaccttctttcccctttgagtagctcttcctcagcttcttactcccaccctgttcctcactagaatacttgcctctccctttgtctgcatgctgtgtctgggctcagggccttctttctctcagtccagttcacaagggccatggggattctcttccccttctttcattatgttcaagaaggcctaggtatattaactgggaaaacaagaaggcatcagtaattaccatagcactgagaagaggaatggaaggaaagtgagacgtgataatggaaagaaaatccctgttttagtaaacttggcaatcactagttaggctgattagaagattaaaaagccataggtcaggcgtggtggctcatgcctgtaatctcagcaatttgagaggccgagatcaggagttcaagaccagcctgaccaacatggtgaaaccccatctctactaaaaatacaaaaattagccgggtgtggtggtgggcacctgtaatcccagctactcaggaggctgagggaggagaatcgcttgaacccaggaggcagaggttgcagtgagccgagatcgcgccactgcactccagcctgggggacagagcaagactctgtccagaaaaagaaaaaagaaaaagaaaaaaggaaaaaaaaaaaagccatatcggcaggacagctttcctgagttaggggtcac

SEQ ID NO: 1508 - DNA, 2868 bp, Homo sapiens
ataaaaaaaattagccaggcgtggtggcgggtgcttgtagtcccagctactcaggaggctgaggcagaagaatggcgtgaacccgggaggtggagcttgcagtgagctgagatcgtgccactgcactccagcctgggtgacagagcgagactccatctcaaaaaaaaaaaaaaaaaaaaaaaaatcaatatgcaaaattcattcactagcaacaaacagcaagtataagttttttaaagatacgatttacaatagcaaaaaatgtaaagtagccaagaataaatatagaaaaaggtggaaaaatgtgttgagaacaaataaataatgagatcttgtagtcatgaataggaagattcaatactataaatacattaattctttccaaatcaacttataaatccaatggaattccaacaaagaccacaacaagactgtgtgtgtgtgtgtgtgagtgtgtgtgtgtgcatagtctgtgacaggatcattttaaattcctcatctcccttctctctcccacccctgctgccccacaccatgtgaggacacagtgacaaggcttgcctttgtaaaacaggaagagggcgcttgccagaactcgaccatgctggcactttgatctcagacttctagcctcctgactgtgagaaataaatgtctgctgtttataccaccccatctaaagcattctgttacagcaacctgtcttagtctattttctgctgctgtaacggaataacagactgggtaatttacaaagaatgtaagtctatttggcccacagttctggaggctgggaagtcctagagcatggggccagcatctggtgggggtcctcctgtggtggaaggtgaaaggcagaaagctgaagtgagtgtgtgagacagagagagaagccagatttcctttataacaacccactctcaccataactaacctctcccatgctaatgacaatccatacatgagtgctccactctcacgacccaatcacctattattaaattcgacctccaacactgactgtggcattgaggattatgtttccaacatatgaacttttgggggactattcaaaccacagcacagcctgaactgattaagacagtgggcttttctatcttctatcattaaaccatccgaaacaccattagtcctctgactgcaggtccagctgtcctgagcagttcaacatttcatatttcgaggaatgcaggttcactcataaacaacacctgtgacagagccaccctcactcacatcctggacactctactgtctgttcacccctgtgcattccaggatgtaacaggcaagatgatcccaactcaggcacagctgcagtgtctacagctgcaggaggtcctgtctccctcctgcccccagcaagaaaacccaagtaaggtatttttttttaaggtatagtttttttccttcaagtttctaattttgacacaatgaaaatattgtatttatattagcaatacccgattagcaatttcatgtaaaggcgattaggtactcataaaaggtctcaagtactccaactaaatcagtcactggttaataacaatgatccacgagctgttttcctggttttcatgtggaataattggcaaggaaaaccatacatgaaaaaagaaaaaagaaaaagatcagcaactttgcagctttagccactatgtgatgtgctatcaaaaagccacctagaatcttttttcatgagttaaaacactactgtcatctataatcctgaacggtaaggtctagaaaccaatactgacagaggtgtccaaacagctcctcttgcagtgctgtggggcacatttcttttaaccttaattgacttcaattactgtgcttcatctcccatggcaaaataattccccaaagaaacaaagagtattagagtgttttcactcatgaaacagcccgtaatgcacctcttttgcttaggaattggaagccaactagatttgagcctgcttgaaagaaaatctcatcactgaagaatccattagtgggccctccaaaatccacacagtcttaaggccagggaccaactggacttcaggaataggatcaaaaaagccaattccagttccatcgtgatgtactgatttaactttgattgtgaaggacagtaatttattgagtaatttatcttgctaaccaccatattaatccagtatccaatcagcacttctctcattcaattccaaggagcaggagtcctagatggttggaagtgtcagacaggaagggaagagtgtcttctagtgtcttgcccagtaattgtacggggctccaaactcctggggagggggaatgatgtctgacttggagcaggccagtggggatggacagagaaaaatttcagcaggtgcccattgctggagtgcaataagtagagcccggggtgatgagaggcctgggggagaagggagagggagggatgacagagaggacaataggaacacagggtcccttgcccttcataatgcccttgattcttgttaaagggaaatgccacggatgtggttggtggagccaacatctctgcctcatccttgatcatcccacacaccccacatccaaattctccctggcgtgttgacccggctaccaacctcacctgcaatcctccctgggctccagctccacctgccctggctgaacctccccctctcacctggactctgaggtggcctcccagtacctcaggtctactcttccctgtcaggacacctgttttagcctaagtcggctcctgtccctcccaggttacagtctgtggcgggaggcccaccagtgataaaatctccgcgccttcccccgtccctggctggcaccctctgcagcctatttctg

SEQ ID NO: 1509 - DNA, 2589 bp, Homo sapiens
acaagaagcatggcagcatctgctgccggggaggcctcagggagcttccaatcatggcagaaggtgaagggaagcaggcacgtcttacatggccagagcaggagccagacagagaggagcgaggtgctacacacttttaaacaactagatctcatgagaattcactatcatgatgacagctccaagaagcatggtgttaaaccatgagaaaccaccccatgatccaatcacctcccaccaggccccatctccaacactggggattacaattgaatatgagattcgggtggggacatatatccaaaccacatcaatgacttacatgtcaataaagagatataaaattgttttgttttttgaaaaaaatctaatattttaataagccactctctcaagccaatacaaggcagctccagcacacccctgcttcaggagatgtttatgccacatgaagggaggaaaccataatcctttccacatccctcaggtagacgtggaaataaggataaggtgaaaattacaaaaaccaagctcatcatgcctccttcccttgccaccaaatgcttgtatttctttttaacacctgttccccgggttgtataaaaagtcctttgctaattacttttaggaaaagggcgacattctggccttcacctcccagaaaccacgcatcatacttgaggcacacaccagggaagaggctgaggtcaagttcaccaatcagaaacacaaacagacaaggaaaaagaaggcagcaatcagtttccatcaaagccctcagccaggtgtcagatctcccagggacacccctctttaatttgggggggacataggtaaatatgtgtatccagaaagcctggagcaagtcgagagaggcatttgattagtatgcagatcacaggcacagctgggatcagggctaaccagactttcaaggataaacagctgacaaggatatgtcatgttgtccctgcagtgtgttgaatctaattaaaaaggacttagggtcagaaaaacactggtgtaataatgggtaagcacaacagaaatcattttattgtttacttacaggaaacaatacttttcccgtttacatgcttgacgtggccagcaaggaagagctcacacttcgtacaaaactacacactagttttgcatctctttgttgtgacacacaacctctggtttagattctttaaaattatctgtatgggacagtttctctcattattcaaagaatgacttttccccaaaataaataagatatattccttccctccgctgtcgggtgtttctcatgctctcctcttttaattgtcagtataattctagagtaaaagtcctatgtgctatggtttgaataagctccccaaaaagcatgtgttgaaaacttaatgtttggctggacatggtggctcacgcctgtaatcccaacactttgggaggccgaggcgggcggatcacctgaggtcgggagttcgagaccagcctgaccaacatgtagaaaccctgtctctactaaaaatacaaaaaattagctgggcgtggaggcacatgcctgtaatcccagatactcaggaggccgaggcaggagaatcgcttgaacccgggaggcggaggttgcagtgagcagagattgcaccattcactccagcctgagcgacagagcgagactccgtctcagaaaaaaaaaaaaaaagaaagaaagaaaaggaaaacttaatcctcaatgcaacagcgttgggaggcgggggcctatgggaggtgctttggtcagcagggctccaccatcaggaatggattaatgctgattataaaagggcttgaggctgtgagttcaatatcttgctctttctttggccctctcttgccctttcaccttctgccatgggatattgcagcaaaaaggcccaggctagatgctggcccctcaatcttggacttcccagcctcccaaaatgtgagaaataaattacccagtctgtggtattctgctatagcagcacacaacagactaagatgcactgtcaagccaaaatataatgatttgtgaacggctaacagcacaggttggaatctgatgccagctaactcccaaggtctcagattccctacctgtctcccatgcatagttgtcagaagtaaatgaatgaacgtacagaatgtgctcaagcagtgccctgcacacagcaagggctcaggaaagttagcgaccatcatatcatcatcatcatcatgatcatcatgcagtcagtattaggtttgtataaaaatatcaaagagcacattttaagcttatgtccaaacatatactaaaatgtgttaaatacgtatcttttatgtaattttccacctaaatttctagtttctgtgacaatgctaagtaggaaaaatattttaattcattcaatgctatcataatgaagattttgtttgttttctttataatgaaattagtgcctgactatatctaaatttacagaagaaaaagaacgtatattcactgaggtcaggcctgcgatagcaaaacagaggggatgggctaaccgcttctcagcaggggtaaagtactctctgctgcctttcaaa

SEQ ID NO: 1510 - DNA, 3771 bp, Homo sapiens
caggcagaacactttatctctaatgagcagcaagcagggctttcaaggcagttaagaatttcctagctgttttcttcctcatcgcaatcaattctgaaaggcatgttttcatagttcgaggattctaagggctacgatgaaagtctctgctattaggttaaacatttgaacaacatattaaatattcaaatagaacattaggttgaactttgactgagcgtattaaaatactttaaggttaacactgaaaaggaactttttgtagtaaattaaaggtggcttctcctcctgaaggaaagtggagtctaattcctagcctctcgcacaccggccggcctgtgacttgcgtgatccagcgaatgtgacagaggtgacactctgggacacgggaggctgagttgtaagaagcctcttggagcctcttagaatgctggctctggcagaagccagacactatgtagcaagtatcactcacgtggtgaggaagcccaggtacccacatggagacgccatctgaagacagaaaggtgtctggccagccctggctgctctgtctatcccagccaggcatgtgagtaaaggaacctttttggacattccatcgcagcagaaatgacatgcagaagacccagggaacccagccaacagtgggaaccaagatcccaaacgtatggccccagcacagctgccccggccatctccagccatcagtgagggttctagtcactggtctgtctctgggtcatcctgctaaattcctcactcacagaatcatgaaaagtggttgcttagtgccactatattttggggtggtttattgtgcagccatagataactggagcacacttttctgtgaagtattttctttccagactcgaacagttagatgggtttatccggaggctacggtgtaattgaaattccattaaagatgctttttaacaagtaagcaggactaatgtatcttcccactgcaaaggcctgcactatctttgccaaaccacatcatactctgtgaagtcatccagtacaacacgtaccccaagttcatactctttaacagctctctgaatcaaatggagacttagtcagggtgaacagtgtcactgcaacgcttgcaagcaaagtaggattcaaccccacagcagaggtcagaaatgccaataaaaatgaccttctggggtcatttatgggtttcacagctctgatttcaagaggtaccagatatgccaaagaaaatgtggccaaagacctggaaatacgggctcttctgattcagtagggccaggggtcgctgccccagccagaggtcagccaccttggggtcagccaccctggcactgcccagctaagacagtccccacagaacctgagagctggctctccattgtgtctctccagagaaacagccccaacttctgttggttgtctgtacagacttcaaaggaaaaatatcttcctcctatctcatgaaaacattccttgctggggctggacgcagtggctcacacctgtaatcccagcactttgggaggccgaggcgggtggatcacaacgtcaggagattgagaccatcctggctaacacggtgaaaccccatctctactaaacatacaaaaaaattagccgggcctggtgtcgggcgcctgtagtcccagctgctcaagaggctgaggcaggagaatggcatgaacccgggaggtggagcttgcagtgagccgagatcacgccactgcaatccagcctgggcgacagagcgagactccgtctcaaaaaaaaaaaaaaaaaaaaattccttgctgggacataaacccttttcctatcgtcatacttgtccaaactgtgagttcacagccaatgataattggatgcgtggcctctgctgggtagataacctatgccaaactgttttcaaatagacagaaaaccaacattaatatggtttgttgttgttgttttgagacagagtctcactctgtcacccaggctggagtgcagtggcgtgatcacagctcactgcagccttgatctcccaggctcaaacaaccctcccaccttgcctcccaagcagctgggactataggcacacaccaccacattcagctaaattttatttttttagtagagacaaggtctcactatgttgcccaggctggcctgaaactcatgagctcatgtgatcctcctgcctcagcctcccaaactcctggaattacagatgtgagccaccgcgcccagccttagtatgttttaaaagtcaaaagaaaacagtgtactaacagtgacctgaatctgcctgcacttggaggctcaccgttttcacgtgctcacgtatgccatctcctttaagcctcaggtcaagtccatgtcatgctcatttcagcaaaaatgtcaggcagctctccctggcccacagctggctcctggtagggcagtcaaagtcagatctaccagatgccagcacccatgagaaaaggatctggatggtgccaacctaataccccctccatccccagccaccagcagcgccgaggtccttccgtccatgctgtgtgcatggcttttctcatcccctctctgaccccagcagctgggtgagcatcttacagatctccttcccagatcccgtgcaaaatggccagaattctaggtctcaggctgttcatttgtttgatgtgaagttagacttagttaccttggtgttaggagagaacagtgtttaaattatgtgtggcaaggaaaattaatttgagattatgaattccctgcagcgttcaaagagtatcatggagcttaagagcaagttggctgggtctcagtttattgacctggaggaatgtggaaatgctaagggaaagcatggagctgaagagtgctgtgcggactgtcaatccatttccatctgaaatcacactggaaaacagaaaagcctacctatggatctgtgtgggggcatggagaacagtgtgggtggagatgcaaaaagctccacctcagagagctgggagggaagcggagtcagggagggctgcctgcctttttctgtagacattcccctactgattgactggtgacagtgagattttatcacgtttgtaatttccagaaggggaaggcacaatgactggttacagtgagattgtattacatttgtaatttacagaaagggaaacacacaaactgcaagagaaatagatccctagagagcgtggtccaagaaggctgtgtccacatttccacattccctgtggctgaatgcccagactttgagatcaaccccatcaggaagaaagttaaagacagaggctaatcagagtttggcaatgctgagagcttccacgtgccaggtcctgcctgggctctttacctatattacgtcattcagttttcacaacttccccatgaggtgtcatccatgttacaggtgagaaactgaggcacagagacagtagcaatttccctatgatcctaaagtgatcagaggtacagctgggattcccatccaggcatcccaaagcctgagctctctatgttgtgacacttcatagttgtgttgacttttatcaaatcattcaacctctttgagggtcatttttcttatctgtcaaatgaaggtgacaacaacaccttctttttgcaaagattcctttgcaaaaaggaatcttacatatctttatcatatgtatctatatcatcatacatgtacgtatatcatctcgcccagtgcctgcagacaggagactgcagagctatgtgcccaaccaacctcac

SEQ ID NO: 1511 - DNA, 2096 bp, Homo sapiens
ccatcaaatccactgataagggacagtttagggagtgaggagtgcatgtcccacagcccctctgcatataaggagtgaagaggagggtggtgatgaggtaggacaagggttggaataggagatgagactaagaaaccaggcagctcaggaggctgaggcaggagaatcacttgaacccgggaggcagagcttgcagtgagccaagatcgcgccactgcactccagcctgggtaacagagcgagactccatctcaaaaaaaaaaaaaaaagaaaagaaaaaaaagaaaccaggcaggcacagatggccacgtggagaggtcagcccctgagagggctctggaccacagcctgaacaaagagcacggatgcaggcagctgccttggaggacacagaggatgtctctttgtgtcgcctccatagggcactggtgtctggaagagctcctcggccagccatcacttagatggctggctgactgggttaactttccacccactccctcctccaaccacccagcttgatgttccttcaatacctcttcaacactcatgaggagggacgggagtaaactggttttcttttaataaaaaatattatgcctttctttttaattgcaaagtaaggtttttaaaaataccatttccaaataaaacggttgtgggaggcatagtaaacatttaaaatttacatcatacaatgaattattgattcccagcaaataatactccccactcagtttcagattttcagctgaatgtagcagggcccgagagcctgtgccaggcccagtcctctacatcagggaccagggaacacttggatggggtggggttttatgtgtctctccactgccctcaaaggcactgccaatctcagcaacaggaaggtgctgactcctgactcaccagctctactgcaagtccatcacctgcaaaacctcagtgatttggtccagtgatgtgctactgcccagcactagtggagttggcacgagatagggcccctggcagctgcccagcggcccacccctccattcggctttgatgccatgggagagggctggggccagtgacagtcaagacccatgggcccaggccttcagagtggctcttagcataagggagaagggggtcaaataagggagaaacagcagggaaaattgaaaagacattctaatggctagtggggtggagatggaacaggtaaccaggtctttctggggacagacaggcatgatatgagagatccatccaaggatccgtgtttaactgggacaggtgtgcagcttcgggatgtggggatgaactgtgaagtgaagacagaaagaaaattcgtgcgctgtaacaggctcagtgctctctctaccatatgtcaccataatatttcaatcattagatctgaactaaatacagatttaatttaccaaataacgttttaatgacaacagcagtggcccccagcagcactccaatttacgtacaacttcgagataaattacatcgtttgacttgcgagaaagatgtctaattaggaagatttccagatataaagaactgtcactgtaaggcatgtcatctcatcactctaaagtcactcattaacatatgaaaacattcccgtttaataaactgcttatgtcaaacgaggtcctgaagatgggacgtgggtgaaggtgctgcccagtaggcggctcaactgattcatcacctgatgttatcggccatggccatccctccgccttcagatggagtcgccagatagatatttttgccatacaaggttcttatttcattttatcgtattctgattttctagctgggtatatttcagaattagtatttgtgttaggataagacactaagattctcttgaagcactggtgttttacacagtttatcttaaaggctgcttccaagttgctgcaagataaaactgacttaaggagtctgtcaattagatgcaaccatggtaaccagagaaaactgcaaaatggccataattctgcaactttgccccaaatgaggacaaaaccaccctgtatccaatacaatacatatactgggttttgtagtggcatgaagaaatgccttctgaa

SEQ ID NO: 1512 - DNA, 1709 bp, Homo sapiens
actacaggtgcatgccaccagacctggctgatttttttttttttttcgtagagatgggggtctcgccatgttgcccaagctggtctcgaactcctgggcacaagtgaccttcccacctggctttgaatatttttaaatttactttaaaaaatgggcttggccgggcgtggtggctcacccctgtaatcccagcactttgggaggccaaggcaggtggattacctgaggtcaggagttcaagaccagcctggccaacatggtgaaactccgtctctgctaaaaatacaaaaaaaattagctgggcgtggtggcaagtgcctgtaatcccacctacttgggaggctaaggcaggagaatcacttgaacccgggacgtggaggctgcagtgagcgggattgagtgcactctagcactgcactctagcctgggtgatggagcgagactctctgtctcaaaaaaaaaagggcttaagcaatttccaattatttaaatttttttgaacttaataagcccaacaagatctttctcctttctaattaatgctaccaggtgagcatcttgaaaaacagtggcctataggtgggtcaccattctccgttgacacaagccctcctacaacagcacctcggggagggagcctcaatgggctccagtgcttcacctatgatgggattctgtggatttaaaacgaagacacaccactgaccttcaagaatctccctggcagatatctcccaaacattcagtcctgatacaagtatcttcataactggaattcacctacttccagaacgtcaggatgagtacccaggacagctctgactgcctgttgcttaaaaccatgcccaggtcataaagccctcactgtactgtaccctaaatgcacttaagcgactgttttctacagtgtcctagtactgaatgttgacactaacctatgaaactaagtgtcatacttactgtgaggcagagaaaccatcaactgaccacaaggtttgtttcaagaacaaatcgagacgaaccaataatgcagaggctaaatttttcaaatcaataataatacagttcacatgcaagagcttttgaaaactcttccatatgataaatatcacatcacatcggtagagatggaaattagattgctcaaccaggtgaatcaaatttaatccagctttttccatcctgttttctaaatatcttgtattattttaaattagttttgaaaaatcaatctgaaagtataaaagatacaaatgaaatctgggtcttggagcccctgggtctaggagcctgattccaagaacacatttcacctgcagctccaaccaggggtctcttcccaacccctggcctgaaggtctccagcctgggatggagcacctccttccttagaaacaaacactgttactgcatctacatgaaatggctcaaaagagttaagagagaatgttgcgatcactgaagaatggtctgaatgagaaagaaagagtagtggacatttaaagcttaattgccagactcagcttttcccttaatcagggaaactgacctaatgagaacagaggggtctctgtgaagctgccaagctcaaaggaggcaaggcagcataaagagacatctgaaggcaggtgtgacatccaaactaggagaagctcagagaaagaagcaaccagggacaggacaacctccatgaaacgatgtgtttgagc

SEQ ID NO: 1513 - DNA, 1736 bp, Homo sapiens
actctatgaggaagttaaactgtaacaagaataatacacagttatgaagaagaataagaaatggtctccttaagccagcgttacttttaaattgtaggtctgggctgggcgcggtggctcacgcctgtaatcccagcactttggaaggctgaggtggagggatcatgaggtcaggagttcaagaccagcctagccaacatgatgaaaccctgtctctactaaaaatacaaaaattagctaggtgtggtggccggcgcctgtaatcccagctactcaggaggctgaggcaggagaattgcttgaaccctagagatggaggttgcagtgagccgagatcgtgccattgcactccagcctgggtgacaagagcaagactccatcacaaaataaacaaacaaataaataaataaataaataaataaaaattgtagatcttgacacatcagtggtttgttaaatcaatatagtgggtgtcagcatttttagatgaaataaataatagaacacaacactgcatgcagtaaatgcaagatttatttcatgaatcttttgtttctggtatatgtgggagaagggtagcaaaacaaactgtatttcctatttggatcccattcaaaaatgtttgaaagctactggctcaagcattgcctttacaaacagaatatactaatcagagatgaagatgaagggacacctgaaagaatgtccctcctcacacgctggcagctccagtatcacaaaggttattattataggtaggttacgacaactctgtgtcgttagataagagtggaatatattcaaaagacagcccttgtctctctctgttctacacaaagctggagtataatggtctttccaaagcagtaacaaggttgtaaaactctcagggaacttggttagacctgagtgatctgttcagctccatatggagatggagagaaatgaatgtggatgctaaactggactagatggtatctccccctctctatggaaacactccaattgaattaggctcaggaagtaagccaggcctggcctccaacaatcacacacacacacacacacacacacacacacacagagagagagagagagagagagagagagagagagagagagagagagagagagagagaactgaggcatcctccattggagctccagtctctttttctctcatacccacgcaccatgctagggcctgtacaaactgagttagaaaaatagtctcagccgggtgcagtggcacatgcctataatcccagcactttgggaggatgaggcaggcagatcacctgaggccgggagttcaagaccagcctggccaacatggcaaaaccctgtctctgctaaaaatacaaaaattagccaggagtggtgacacacacctgtaatcccagctactcaggtggctgaggcacaagaattgcttgaactggggaggcagaggttgcagtgagccaagattgcaccactgcactctggtttgggtgatggaatgagactctgtctcacacacagacacatacaaaaacgactggtttgaaacaggaattttctttgctcaagaaatccctctgttctcattgctgaggctcaatctattatatactcaaattaagatattatgattaaaaagatcttcaggaccaggtgtggtggctcatgcctgtaattctagcatttgggaagtcaaggcaggaggatggcttgaagccaggagttcaagacca

SEQ ID NO: 1514 - DNA, 1379 bp, Homo sapiens
aacaagaaaggtcagacaccaggtgaactggaatgagaacgaggaagaagaggaggcagagctggtccttctcagcaaatgctggagacattataaggagtaaagcatggtgtctaccctggagaaacgtttagtggagatcagaaagacatataaaccaatttctacaacatggaatgtgacaacagaatgaatcctattacagcagaaaggatatatatcaaatacacaaagagacacatatgcaaaaaaatgaaaggcatgtcatggtgagatttaaccaaaaatcaaaaacatcactaagcagaagatgccactgaactccaacatctgtgcagtagtgtataactactggattcgtgtcggatgacttgcctaagggtgaaaaggcaaggcaagggccttgtcggatgacccttcagagcctcaacttcctctttataaaataagggaccgtgatcagatatggaggtttcttttagaaataaaatacaaattaacaaaagcagaagcctacaaaccagatacacgaacctctttcagcacagggggagaggtcaatgccttttggagatttaagcatgaggcaaaatcaaattaataaatagaattttaaatgtcacgtctgtgaatgtgacattgaattttaggatcctgaaaattgcagcttataatggaactgctgacacaacctcaaccatagcagcaaatgcactaccacaatcaggttgttatggcaactagaatacttaggttaaaatgaggaagagagtctgtgtctcgtgtgtgtgtgtgttgtgtgtgtgagagagagagagagagattttgttgccacttccactagaaatattttaaaaatgttttatatttaatctcagaactacattcatcacttagcacataagtatcttattaatgctttgggattaaaaaaaagaacttcttaaaaaataaaaataaaatgaactcttttgaaggggttcaaagagcacctaaccaatgtctacagctgacacagcttaacatacctccctgacatctccagattaaactagctatttcctccttcatgtgagccccattttatcttctgctgtatagcgacttgagtataacataaagataacattattccttgatatgcttgtcttccgcggtccattcagctgtgtgggagcagagtttatcccttagtcatgctcatatatccagtgtctagaacaatgcacatgttttaggtgctaaactgtttgttcaactgaggactaaagtaccaatcttatcaaattttaaatatgaagtctttacataaataatgtaactatttttaccttatcaaatgtatttctggtaaaaatatttctttttcttttttcttt

SEQ ID NO: 1515 - DNA, 2238 bp, Homo sapiens
caattaagacatgaataggatgctcaggacctgattaacttcaaattttttactttttattttaaaagatgccagatgtccatctacaatctcctatatcacatcttcagcaaagttaaaaagaaaaatccaaccttggagattttatcatattaaatatcaccatgttcataattgaaacttaacttcaaagtctctaaatacaagttctgatctgctactgtctgctttcacttttatcttttagaaatgtacatgtattttcttctttctttctacctcattctttgtttaattgctttttgtttctttcccttcattcctttttcctgccttataccttcctttcccatttctttcttgcctttccctacttcctctcttttttctgaccttcagtcttttttgtcttttctttctctagctctccctgtccctcccatttcttccatcttcctctctttttttctctctccttgtgttcatacctttcatacaataacaatagctagtatttttctttcaactcactcctaaaattttctttcttctcttttaaatatccttctgtcactcaactctacttttcaattacttttccatgccagtgattgtaaatgaaaagttattcccacttgataccattggagataaagacaataaaaatctgcctcatttaaagtttgtgtgtatgcgcatgtgtgtgtgtgtgtgtgtctgtgtctgtgtataaaacctaatatgaatttttattatttcagaaaatgctatgagtgtatttccagaaagctggttttgataggaagaaagaggagtaagcacagagcaacgggaggaaagggaccactacaaagatccacgtttactacaaagactcatgtttgcaaaaaaaaaaaaaaagggggcctaacttgaatttaagagtcatatattccttttatgaggctcagcatacttatctgaaaacaaaaacaaaactaaaagcaaatactacagtaataattacaagttgactacattttattataaggtgccttcacaaagagccagtttcatttgttatatctccctggaaaacctttctagcccatcttaagccacaggtcctggtttcctaggacttaaagatgaaatagattcaaattactttctatttcaggtaaaatgtgtgtctactttggttcctctgtgaggtagaggagacaatatccagcttctggtggtaacaccgctcccaacttttgattaagtcctttaaccttcctctcctgtaaatcatataaagtagcacctcaacgaacagcacttggcgaagtggaagggttaagtaagataacaaatgtgaaatgctttgagaaagctaatacagctttataaatgtgttattaaaaatgccattttcataaaccaatgaaaatacctattctggaaatataatgatatcctacctccatggtttgttacccagcaacacattgggtacgtaaaaacttaacaacttgaaatatttctcatgcaagatcaaaacctccaagttttctgcccaccacctgtaccctataatacccacaaaagggatcacttagaaaggaagggaaaatattatcattttaaattaatttagcaccatggaggtgctaagtgatgttcagaataatatattcaaaataacacatggaaataataaaatcctaacttgcttattcctccctgaggcaaaagtttgatttgctttattcttcctcagtgtctgcgtacctcattgtttaccaggtaactgcaacgtatgatgtgcggacaacttttttcaatattttaaaattataaaactttgacatgaaaacacttttttactcagttgattttatttctccctctggtgtcagggatgtgatgctgttttgtcaggcagctggagacaagttaaaatagctcaccaaagggagaggaaatcataaggcaaagggagatgattctgacgcaaggaaaacctctcaataaaataaacatctggggccacaggggacaggtaatctgatgccctgcagtagcttgttatcagttgcaattacttcttttccagcacagaagtattcaaacttcccccaaatccaatccagtctctgttttacttttagatttcaaaacttaaatcacagttattaaccaataaacaaacaaaatgtattatacgaaacagctctgaattcagtcctgcaatagggtactggaaatcag

SEQ ID NO: 1516 - DNA, 2746 bp, Homo sapiens
atagaataatatgttacagtgtataaacacaaatatatacacacacagaaccgtctatctgtgtcttggagattcagactagtaatttgtctaatgtgtgcaaactccttccgtgggcagaaggactgctactgtgtgcccagatgggtacataggacaaattatgtttactcaacttcagagaaaccatgccaaaatgttcttcccaaacaattgatttcaacttgttcttgttttcctccaatagcagcctgacaaactgttttatacatgcatttgacttttcaaaaatttgcatgcaatcatggcaaactcagcaagtctttgtgctccaggagctgcagaatggcctttgaatgacatgtttactgcatcctaatgtaaaatgtcatcttcttaaagtctgggagaaaggacctgcagcagcatgaacctggcctgaccctgtgttatgtgcatcagcaagagccaaatgcctaaagcagccagaaagtaatgccatgctcccaaaagttcagagtgacaaaacaaaaaaaaaaaaactaaacaacaacaacaaaaaactaaataaaaagtccaagcttcaatgattatgttactctctgtcacctgactcttcaatgaacaggaagcatactctctactaaaagggatacaaggccgggtgcagtggctcacgcctgtaatcctagcactttgggaggccaaggcgggcagatcacgaggtcaagagatcgagaccatcctaaccaacatggtgaaaccctatctctactaaaaatacaaatattagctgggtgtggtggtgcatgcctgtagtcccagctacttgggaggctgaggcaggagaatcacttgaactcaggaggcagaggttgcagtgagccgagatcatgccactgcactccagcctggcgacacagcaagactctgtctcaaaaaaaaaaaaaaaagagagagagagacataagcagaaaagcaatctatgacttagtttctgtcagagccttgagtctttctttatccacagagttagaaaactatgaacccaaactgcaaatgtaccatttcctcaccaatggtcatttgtcacttctgatgcctcttgaagagaccctgtcacagttgtgacttaaagaagactctacgttttactgcctccattttttacattctcttaattcctttaaacttcatatattagaataattagacaaagtcacctttttccaacatctacacacttcatgcaaagcaaattctcatttaaaaattatcttttgagcttttaaaatagactatttgctacttatataaagataattgatttgcaaatgaagagtagcaaactgctccccacctcctggacatgtttataaagttgagcaggacagcagtcatatatcaaaaacacgacaacattatctttcagtttcctaggttaagggcaacctcatcagaaactgttcaggctgggtgttacatggtttctgcatggaagccaatcaccttcacatataaacacctccctcacatcaatatgttgtagttctagtaagttcacagtcattttaataatcaagagaggtcgggaaattagtatgcacatgaccaataaaataaatagccacagttccctctaccaatgctcctcaaactttaacatgcatgcaaaccacctgaggatcttgttaaaatacagattctgattcagtaggtctagagtggggcctgagattatgaaatcctaacaaactcccaggtaatgctgctgctgcttctgctgatccatggaccacattttcaacagtaagacaatctaccatgacctctcttggaggtggtaatgtccaagtaatctctttgacacacatgaattcccatcatatgattatgaaaaaggagactgttaaaactgaaaaaaaaatgtggaaactgcaatcatgggttctggagaatggaaggaagaagtgaatttgggattcttggcccctattttgattcatatcattattctattatctgttcctcaaaatttgcttggcatcctgactccctcaagagagatggagattgtttgttgccaagggccaccagtatccaagatacaaaaagatacatcttttatcctctacttgcaagtaccataaagaggccagctctggggtacttttaggcttgctatggaggcagccacaacactatctctggcactagaaatacatctgaacaatctggaattaattatagagttgcaaagaattccacaacatctaaaaagataagcttgtatgagttcaaccgaactattctgattaagcaatttttgctagctttccttctttctgatttaacccagagcatttaacaagcactctgaaagcccccctacactctgagtctagccacacaaaagctgaaatccagtcatcctgactgtatctaatagcttcttcttctctttttttttttttttttttttaagatggagtttcggtcttgtcttgcccaggctggagtgtggtggcatgatctcgactcactgcagcttccacctcccgggttcaagtgattctcctgtctcagcctctcaagtagctgggactacaggcatgtgccaccacacccggctaaattttttttttttttaagtagagagggggtttcaccatgttgtccaggctggtcttgagctcctgacctcaggtgatccacccgccttggcctcccgaagtgctgggattac

SEQ ID NO: 1517 - DNA, 1855 bp, Homo sapiens
cctttggtactagcatttggctaatcaaattctaagatgtctgcaggactagctgaagtcatatttgctggatgatgaagctcccgttccttgacaattacagtcatattggtctccttctccactgcattcttaaaacctttgaagtctgaccatcctttattctttattatgtgtgggactgaatatgttctatgcttgtatcttctctagaagactgataacatattatattttcattgaatgaatgtttggtcaaagtctgctttggttagcgttgccagataaaatatagaacacttagttaaatttgaatttcagataaagaatgaaaagctttttagtataaacctgttccaaatagtgcatgaaactttattgtattaaaattcattgtttattatctgaaattcaaatttaactgaagttttatttttatttgctaattttggcaactctcttggaagtgtttttacttcaggcctctcttagaaaaattcttctttgtggcaaagaatatttgaggattaagcaatctgcaaaacttttatcttaacctataaagcataggtctgccaggattttttgattaatctgctccagtttttgcctgtgtaatcctcacactctcatttaataaaatttattgtaacataagttttatttttcttatacagaatataatctatgtaaagttgtatatcttgaatatacaaatacttttcatgaatgctagatttccatggttacatataagaataattagcatgtagaattcaaacaagaaagcaccaccaataactgacatataaatgcataaacatcactatagtgtcagttgtgtgagagtaacgatttgcctgtgtttccttctgtctcccatctccagtacctaacacaagtggtaggtgccctataagtagctggctcttactctgccttctctatctcatccatccttctatagacattggagtcacaggtcaccaggatttcttcctttatactctgctttctaagtcagtggttctcaaagtgtcatcagtcccttggccagcaactgtcggccacacctgagaacttgtaataaatgcacattcttaggccccattcctgagaaagggatgagaaactgcctgagaaacactaggggtgaggccaacaatctaggttttaacaagcactgcaggtggttctgatgcactcttaaagaaccactgggagaaccaatggttccctgtgtttttatatataaaatacagataacggatgtgtaggtaatgatcacactgctgaaatgaacttgatacaaataaatcttagtcactagtgagactttaacaggcctttcctctgttttactttttaccccctttcctcccctttgtctttgtcctcacaatctaaggccttgtttcttcacttttaccaagtagtatgttgaaaagaaaaggcctggccattcgtctcctcctcccctcttcctcctcctctttgccttccttgttcccttcctcctctgctttcctcttttctcccttctctttttctctctcttttatttggcttgaatgtcgagcttagcggttgaaatccttcaacaggcagttctctcatcctgtctgtcactcacataaatgagcctggactagcattgtcttgactgatcctaaaattttattttcagcacaccaaaaccagcttttcatgaccagcttttcatatccaccttcttgattctttagcttctagacagttgtctccatccattcctctttcttaatctttcagatctctgctattacttgctattcttgcaggtcgttatccaaagagcacgccccatttgatgtat

SEQ ID NO: 1518 - DNA, 2896 bp, Homo sapiens
tctgagtcacactggccacatttcaaatgctcagtcaccacatgtgattaatggctatcatactgaatagcacagatgtggaacataccactattgtagaaggacagtgcttcatgagactacaggcataaggtgagaaaattgatcaggggctaatagagagcaagggtgtcctgtttcaggaaaactcaacctgtgaacatgcagatttacacaaaggaaaatttaggaggtgtccattctcctcatatggcaattcaaaaaacatttttatccaactacctccactgattaattaaatatccctaatcatatttagaaagcagtcagaaaaataaaatgaatatgaaagaaagtaaactaaaatgtaaggctattatcaaacactaaatcacaggaaaccatatactgggaaattttgtcagagggatatagtggatatttgaaacatatgtttacatctgtctttgaaaccagccaacctggatttgggtccatctttgcctcttggctaatggccccatgaacagaagcaggcagaactctgcaggtttgtcatgaggatttgttgtggaagcatatgtgcatagcagcacatagtaggtagtttgtaactactaggacttcccttcttcctgttttcttcctcaccttctcctttgggtgttctcttccttcttcctttcttgcatcctaggagcccagagcctgtcagttccacactcaccactctgcattttaggggtccagctatgtggagagagaaatccctctctttttctgtgacagccccctgaacagtcatctctgataacgccatggtttcattcagtcaaaatggacatatccccttgataagggatactacccataaggccactgatggagatattttggacgagttttattattccctgagtcacatcaaaagggggaaaatagcatcaaactagaaattaggagttctggatatgtttcagcgctgacaatgatttctacaagtcctatacttcatgggcttctattcttcatctataaaatggaaaggttggagtagaaagtctcttactgcctctttcagctcaaatctaagtaagaactactcactgcctcccagctagactagcagctctgtgagggcagggacttgggctgtctgtccctgttgcagtcccaatgtgctagcccagtgtccgtcatttattcaatgctcagtgcgcatttgaggaacagatgatgagaggagcccaatctgcctccctcgcacatgctctggtgggggccctgtgcctctattgcagactaccttcactccactcagcctctccccgcccctccactctctccagcattatggctgctgttctctttatttgtaaaaagttgcagcagctccactgtgttactctaccatttctgatttctctgtaaagctggggctgagaaacaaactgtactgtgtaattatccttgcaacactctcttcgaagaattccaatttaatagaattaccaagatttaaaaacattaaaacaaaaatgagcttgttagagtaaattagacttcataaatgtgttctccgtttattacaaaacattgatttctgtggtcaccttctctaaattattgaaagttgagtagactgccttaattggcaaggagaaatgtcaccagccaactctcatagaagttgggggttgggggcatgcatgggatggagacacaaagaaaggggaaggaaggacagggcccagctggctacatagtcctgtggaaatcattatggggaaacaactcacgcctgccttggtgaagctctgtgagaatagcaatactagtctgggaaaggagtggataaatagtatgctaatggcgtgcagtataaatatagagcctcctgattccatagcaagaatggagatgcttgtttcctaggcaggaaaatcttttttcatgatactggaacctggcctaacacagattaaccagcagaggtgccccgggttctccgttctgctcctgaccaggatgactttaaactctggcctctccgtgtccccatctcacacgggcactgatgcctgctgactacacctccccccaggcctcttatgtgagcttgccagccccaaagaaatctactctagtctctgagcttcttggagatcatagtaatcagtgggaagagagcagagtgccctctctggagcctcctaaccaccggtttggagaggagagcagtggctgtggccagccataatgaagcccccacagtggctggcctgaggaagagggggaggaggcagctgcaagcctctgagcttcactgccagtactccatcattttcttgttactgaaggactggcagattgagaggctgagtttgtcgaattatagagagtgtgagcttccaaaggcaacagtgtcatgctgctcatttgctgttggggaaaagtataaactcttccatgctaatgactatattgtgaagcctccaaactagtctgacttttttagcaaaccttcccaacactgctgccctttatagctggtcaagtttaattagaaagaaaaagtctccaaataataataataatataataataattttaatagtattcacttactatattctagaaactgttctatgaagttgtactgtaactcagcttatccttatgaacactttaggagatagataatattattctcttttacaaatgaagatctgaggcataaagaggtaacctatccagggtcacagagttagtcagtggtggattctgaaattcaaaaccaagttatttggcttcagagactggactccaagcccctatgttaagaacacaatcctaaaattgaataaccatgaaacacttattatgagcctaacac

SEQ ID NO: 1519 - DNA, 7861 bp, Homo sapiens
aatttttagagtatttttaggttaaatgtgtatgactcacctggaatttatttttatataaattgtgatgaaaacattgtcttaaagcagtgttttattataaatttcaaaataaaagataattatgaagtatagagcagaatcaaatcaacaaatgtttttgctttgcattctctccatcctaaaaaacaacctggaatatttttaaaatattcttattttcttccattatccaacaggactttctgtacattgttttcatgaaatattaaatttgaaaatatttgttaagctcagctttaggaaaaaataattttttattctaatattatttgaaattcttaaatttttagcattatacatttaaacatactttttgtacactgataaatattcttaaaagataaagcagaaattgaagaggtttcagcatatgcgtatattaaaaaataactttaagcctctaaagttagcataaaattagacatattaggaggtataaacgttttaggagaaagtaatctggggagataattactgagaaatccaggggaaaaatacaaacacattccttcaacctttcagtaaactgttctttggtttccatataaatttcccttgctcttggagtaggacttacaaaacacatttttcacatatatatgagaaaaaacacacacatatatgtgtgtgtgtatttatgtaaaccattattttatatgtgtttgtatgtatgtatatacattaatctttattattatcaaaagcccaaaagccagtgagacttgcctgtactaatcatagtgcacaaagatatctattaactctttttatttaaaaaatatctaggagtttctgcatttactcagtatgcaatcgagctttcctagcaccatttattaaggactatcttttccccggtgtatattctttccaacttcgtcaaaaatgagttggctgtaagtgtgtggatttctttctgggttctctgttctatacctttggccaatgtgtctgtttttatgccattaccatgctgttttggtcactacagctttgtggtatgttttggggtcaggtagtatgatgcctccagcttcattctttttgattaaaattgctttggatatttgggtcttttgttgttccatacaaattttaggattggtttttctattcctatgaagaacatcattggtattttcatagggataacattaatctttagctccctttgggtagtacagacatttaatattaattcttccaatgagtggacacaagacacaaaatgtcattccaattatttgcatcttcttcaattgatttcatcagttatcttatagttttcagtatagagatctttgacctccatgtttaaatgtatcactattttatattttataactattatacattggattacattcttgatttgagatagtctgtaattggtgtgtagaaatgcaactaatttttatatgctaattttgtatgctgcggctttactaaattcatttatttactggttccaatattatttttgtggagtctttgggattttctgtatttttaatcatgctgtcctcaaacagggataatttgactttctcctatccaatttggatgccctttatctctttctcttgcccaattcctatagctaagacttccagtattgtgttgaataaaagcagtgaaagtggacatccttattttgttccataacttagagacaaatgctcccaacttttcctaattgagtatgatgttagctgtggtttgtcatatatggcctttattgtgttgaagtatattacttttatatctaatttgttgaagatttttttatcatgaaaaaatgctaaattttatagaattttttttctgtgtctactgaaatattcatatttgattttttgttttttgtccttgattctgttagtatgatgtattacgtttattgatttgcatgtgttgaaccctccttgtattcctggcatgattccatttggtaataatgaaagatctttttaatgtgttgtttaatttgttttgctagtgttgagagtttttgcatctatgttcaacagggatattgtcctatagttttctttttttgttgtatcattgtccggttttgatatcattgtaatgctgactttataaaatgagttgaaagtattcccacctcttcaattttttatgatgaatttgagaaaagttaatatgtgttcttccttaaatatttgataattcaatattattggcaaatatttattagccgtgaagccatcaggtcctggactcttctttgatgggagagtctattattgcctcagtcttcttccttattattagtctgttcaggttctctatttcttcatgattcagtcttggtaggctgtatgtgttcaggaatttatacatttcttatagatttttccacttgttggcatataattgttcacaatattatcttttgtatttgtattgaatcatttgtatttctgtggcatctgttatgatgtctccttttatcatctctaattatgcttatttgagtcttctctcttttgtacttacactaactaaaggtttataattgttgtttattttttgaaaaccaagtcttggttttgtttttcatatttttaaaatctctattttatttatttttgttctgttctctgttatttcttttcttctaccaatattaagtttagttggtttttgtttttctagtttcctaaggtatacctacctttcttgatgtaagtgtttattgctataacttccctcttaaaactgcttgtgctgtatctcataggtttgggtatgctgtgtttctgttttcacttgtctcaatgaattatctaatttcttcattgacccattattgttcaggagcatgttgtttaatgtatatgaatttgtacagtttccaatattccttttgttattgatttttaggtttttccattgtaatcagaaatgatacttgatattattttgatttttaaaaatttagtaagacctgttctgtgacctaacatatgatttgtactggagaatgtttcaagtgctgttgagaaaaaattttattcagcagctgttggatgacattttctggaaatgtctgtgacatctattcagtcttgagtgcagtttaactttgatatttctttgttgattttctgcctgaacaatctgtccattgctgaaaatggagtactgaagtaatctactattattttattgcatcaattcctttaagtctattaatatagtatttatatttttaggtgctctgatattgggtacatatagatttaaaattcttgtgtctgcttgctgtattgacccctttatcattatataattgccttttgttcaccatgcttgacataaagtctgttttatctgatataagcaaagctactttcagattaaagaactcaccttagcatttttcttgtaagatagggctagtgttaaggaatacactcagcctttatttgcctgggaaagttctctctcctgtatgtttcctggatagcttttcttagtacagtattcttggttggcaggtttttgggttttttatttttcccatcagcactttgaatacagtattccactctcactgagaaattctctgaaaggtgtattggggctgtgttgaatgtgatatagttctctgctgttgctgttttaagtattctttatttgactttggttgataatgtgattattatttgccttgggaaattcatttttggcttaaatttggttggcaatctctgtgtttcttgtacctgaatgctgtcatctttctccagatttgggaaatattcacccattatttgcttaaatatgctttctgggtcttttcccttcatctccattaggaatttttattaatatttggtgaaacttaattcacttgatggtggctcataattctcataggacttctttactcttttctattcttttttcttttatctcctattttgtatattctctcttcaagcttgttaattatttcccttctttgatcaagtctattgttgaggctttctaatgtgtttttcaggtcagttattgtattctctattcattgtattcagtattcttcaattttaagatttttacttggtgtgtttttacttgtgtaaatactatttctttgtcaattttctcattttattattagattattttccaaatttcatcagttttctatctatattttcttgtgattcccctgaacttctttaaggagataattctgaattttctgacagacatttcatagatactcaatctgtgccccttgctgaagctttgttgttttcctttggtgatgtcatatttccctgagtttaacaatgcttgcattgatgtcttcacatttgagaagagaatcaccttgcccaacttttgcagtattctttggtggtattagacctttactacttagtaccaaaagttaatcctttgcttccgattctggggaggacttacagcgagcactagaactaaaacactgcactggaactaaactgctaccctacctctctttcctggtttgagtaagacttactctgtgagttgaagctgaaatgctgcatcagaactgaattgctgctctgctattatttcccagtctggggaagacttatagagagtacaagaacttaaatgctataccagaattatattgctgtcctgctatttttttctagtctgatgaagacttaagtggcaccaaaacctaattccaacattttagttatttctaggacagaagaaagattcacatgaacatctgggtttgtaaaaaaatatggccagggatttgggccttcctgcatattgtacctactgtagctctatggctccagccagtctccttactgtggcatccatgctgattagagggaagaatagctgccaagatctgtgtaccactcactgtgataaaagacgtactctttatccaatttaccccaggtgattgagccttcctggcactcccagtctttccagtgggatggaactggagttggcttcccatgaagattatcagaccagtggagagattgaatatccacctccaactccttcctctcacctcagaacccacaggtctagggaaattctttgcaaatggtgttatgccagcttggaggagggagcagcacagactaaaatgactatttctcctactggtcatgccttctctcgatactgtaggcccaagagatttcttcattactcccctgaattcagggtggtgttcctgtctttgaatactttctaattatatttttgtgggagtagtgatacaagggaatcttatattccaccatcatgctgacataacttttctcagtttttttccattgcagggttcacaaaaacggagttatagaaccataacatcactttcagatatatacatccttaggacccactcaagagctactgaatcagaaactcttgaggatggggtccaacattctgcatttaaacaagtcctccaggtacactctaatgatcgaaaatcactcatctactgcatgactcagacaaataaagggaaagttaaaatgtggaaaatgctctgagagaaaaaaaggtgttctacgagtacataggaggctcacataatccattggggatagacagatcatgaaaggcttctaggatgagaagaaggcatataaagaataggtaagttaagtgggaaggatgtgttagggaaaagaaggatggggcatggtgatggacaaaaggccagagagaatattgcaaataaagaaaagccccacaagtgcaagatctcagagataggagaaggttgatgcctttcagagctgaaaactgaagcaaccataaccaatcacagtgctgagctaatcacaaggtttgttttgtttgcttgtttttgagacagagtttcactcttgttgctgaggctggagtgcaatggcacgatctcggctcactgcaacctctgcctcctgggttcaagtgattctcttgcctcagcctcccaagtagctgggattatagacacatgccagcccacccagccaatttttgtatttttattagacacggggttttgccatgttggccaggctggtcttgaactcctgacctcaggtgatctgcccacctcagcctcccaaagtgctgggactacaggtgtgagccacctcacccagtcctaatcatgaggtttttatcgaggtgaatatgtcacaagtcatttgatactagtatcagtgaaagtcataaggactgaaaattatttccttttactggtgacaaatcaggttaaagaagaaaagagatgttttgtaaaccaagttaatggatttggatttgtcctggaggaaatgtggagccactaagaattttaagccgcagcatggcatgatcagatatgtgtttataaaagtgtatctgactacagaattgagaactaattggaggggtgagactgggagcaagtagaacagctatagcaacagactatttgggtaagctgtctgtgttaaatttcctgattttctcttgctaaagaattcatttacaaaaatatgccctagctttttgatgtatgttgaataaaaataatacatacagaaaaattaaagtctaatgtcttaaataaggatttccattttaaaggtcctgagcaattatagatatttgttaaaaagtaaggggaactaacaagcaattttcagtatattaaaaagcccaacaagtgtcatacatttgcgtaaatgcaaattaaaaattcatggttttctttttaatttggggcgaattacatcaattcagtacaggcactctagtgatttagtgctgattggaaactccagcttgacctttacatattgctggagaacagaaacatcagaaaatgagctttttgcttaacagatgctatatgaaagaaaaaacaatgaaattcaatggtagaaaaataaatccatgtgtcttgatagttgaagattacaaaacatgacatttaatctattttataatatagctggacccaagtgaattaggtagtcatctaagtatttattagaccaaaaaatgacccccccccaagaaaaatttaattgcatgaaaatagcttaatttttgagatagtcatattttatttataagtatttacactcagagctgctatgagagggaaaagttagccaccaacaaagctcagagacatcagaatttgagcagggtcccaaatcaatgctcgtttttcttagatgtagggagctactggggtttaatgtcattttgtacacatttaaattcaatttagtatcatcttttgagtggcaccttcttttggaaactgactgagctgatgacagtttatacttttagtgaagtagagtaagacttcactgtagtgacttttttgttggaacaaactcacacaaatctaaataagacatccaaaacctttatggaaaatagtgcccactagaagtgtaatatagtactgactgtacttatgatattcccattaaatgacttaatgaaccttattcaatgtaatttgtgtctagatggtgccggtaacacacttagctagtgattgattctcactgatgaatagctgtgtgaattagaaaactgtgaatgagtctaattatagtatgctagagctactgctagatgtacataaaaacgatcaaactcgggcataaccactgtgcagatgaatgcttttccatatgtggatgcttacactagcgctatgtctatggcaatagctctgattagattgcaaagtagcccctaagatggcacagctcaa

SEQ ID NO: 1520 - DNA, 10169 bp, Homo sapiens
ctgagatcacgtggcaaaaacaaacctaaagctttctcaattcgtgaagaactacaagggccaatgcctcttttaatgttagagaaactttttttaaaatcttgggtgaaaaggtaaaattttaagagggcaaagaccatgccttggacttctatcatatattctgtagtgcccagctcaagcagagtgcttaggtcatcatggtacagtgaaacattcccagactgaaagttaaacaacacacctgctcctctaagccctgccattgctttagatacaatctgttaccttctccctgcctctgcctcctcatctgtgacatgaggggaatagcctaggtgacctataaggtccttctgtctctaactcattgggctctcatgacttccttcaatctatgctcaatggtagtaataggctcatgcaactaattaattttctgctcctcatcttaaaactctaggattggtagagctattttgagcaaatttgctagtaagattttcagtaggtcaaagatatcttttcaaatgtaaaatgactgaaaacggcctagaacaggatagaaaataaaaacagcatctttgttggagccagagggtaaagctgagcttagggaattgctcacgcagaaaagaatgagcacaaatgaaggtgaaacaaattgaaaagaaaaatagaagggttattactatgggccaccagctttctttatcaaatcctaacaagcctttcaaccctgattctctcagcctcagaaatgtttactgtgatgaatccagcagctctacctcataactaggggtctgggttggtttcatgaatgtccactcgtcaggattcatcgcctttgaacaaagagctagtggctgtggagcatttggttttcttgtcaatttctattctattcttcatttctaaggaaaagaaaaaaatagtttggcctgacaaaacaatgaagtgatatgcatagccctattctcctcataaattcccctgaagttattaatcccagttgccaattatctcaattatctttctatattactaacccttttttttttttttctttgagatgcaatctcgctctgtggcccaggctggagtacactggtgccatctcggctcactgcaatctccacctcctgggcttcagtgattctcctacctcagcctcccaagtagctgggattacaggcatataccaccatgcccggctaatttttatatttttagtagagacagggttttaccatgttggccagactagtctcaaactcctgacctcaagtgatctgccctcttcggcctccgaaagtgctgggattataggtgtaagccaccacgcctggcctcttaccaaactattaagaatccaaaatgtttatttattcagatataagatcccaccagcacctaggaagtctacttttcctccaatattattttcttccaatgtcactgccatcctctcagtgccaagacttgaagccttagcattattactaaattttcccttctctagccccaaaacttagtcatttgacccatcctcttagttacacttacaaagtgtttttgaaattcactctacttcacccacttctgctatcacttccctacttatcctataatacatcttgcctagatcatcaaaatgaatgtttttttttctccctacttggtcttaaatacagcttaaatgcttcttaaatacagcttaaatgcttcttaaatacagctaccttcaaaataatctccccaaagtacatgtcacagctctgctcaaaacttagacttcttctttacctacagaataaagtctgagtcgccttagcctagcattaatatgaccttggcctatacttctaaaacatattgttcattaattactggttttaggttaattagccatgatggttaattttatgtgtcaagttggtgaggccatagtatccagatatttggtcgaacagtattctagatgtttctgtgaaggtattttctattgggtataacatacactatttgggcaacaggtacactaaaagcccagacattgcctctatgcaatatatccatgtaacacaactgcacttgtactcccctagatgtctaaacatttaaaaattattttaaacatttaaatcaacacactctgggtaaagcagattaccgtccatgatgtgactcagcctcaaccaatcaactgaaggccttaacagaaaaaagactgatctccccatgcaaaaaggaactctgccagcagactgcctttggatgcaaaccgcaacaccagctcttccctagttcttcagcctgttagcctactcggcatattttgtacttgccagccatcgcaatgtgtgagtcaattccttaaaataaatcacttaaaatctctgtctctcactaaccattgtttctggaaaacgataattaaaacattaccatattgcaaaaaaagatttggtggaaaaatacactcaggaaattctagtttgaaaaaaatagaatatgcttctttattatctgtgttataaaatttaattgtattctaatgtaaactctgaagcaccaaatcatgccagtttgcatccccaaaatacataggaaaaaaatgttgtcaatgataagctggttgcagtttaaaccagctgggaaaagaagatgacagaatactcttagaaccaccactttatccaggtaaccacattaagagaactgcttgggtatgaatagccaccacctccaggtgtagctcagatgtgagaggtttaggcaagttaaattattccacatgagacatgaattggaaatgtggagttgtattttgctgttggagacagcgacttgaagaccttctagataaagtgaaactgacagtcgcaagagattccaccaaggtgggaggcagcggtccaaagagaaacatggccaatgtaattctaggtacccctattcccaagcctttggggaagaaagacagaagaattatcatcccagagttctgaccttgaaataaggcctaagagtttcttacaattttttaaataaactgagctgaaaaatgttgagtgacttgtttaaatgaacacagccaggggcagatctaggaagagaacataggtcttctgactcctatgccatgctgaacgcagaaagctgaggatgcagagtctaaacatggaggaagaggtgaaggggcaagtgaaaagaaagactggagatcaaaaaaggatatagatggggcaaagcccagaggaaggagttacctacaacgtgaaaaaattcactttggaaagtgaaggggatacagcacctctgagaaaagagagaaggcacttggaggtagaaaggagagtggcatgaaagaaatagtttgaggtggagaggagggaagttgaagaagcatgttaaactgtttcttcttcttaggaaagtgaaaagctgagagcgagggggagaatacttcagattcaggtagcctaacgtgaatccagctctaccaccggctgtaggtgcaacttaagtcaagtaactttcctctgctgtacgcaggtaaagcatgacatgttataagaagtcaattaaggtgtattatagttggtgttataatgaagctcatctcgctgatttattgaacaatttatgtagtgcttactatgtgccaagcactgttcaatgagctctacaaacatcctactgaatcatcatagcaactctatcaacaggtagcattatcaaatctcactttacaaatgagtttgaggccagagaggttacatgtcttctttaaggtaacagatggtacataaatcagataaacatgtaaatcactagatgtgctggaagtcaagcgtctttatcctcaactgaagtctaaccaaatttaagcagttaattgtgtactcactagcaaaagaactacagatattaaaagcaaattataatcctcaaacttgatagctaaaattcaaaatacaagtagacatcttatatttttagcattctgtaaacagtaaacctctcataatattatctgttattcaattttcagcagtttatgtttctagaaatttacaacatattaaaatagaagcccctctttatggtaacacgtaagacaatgaagcctttatcttaggacaaggtatatgctcaaaacttcttcaagatgtgacaccaaactatggtttacctatgtgtaagtttatacatgctgggacctaaagagttttagaacaatttcagaaaatattaacatttgcaatcattataatcctatgtgttttgtcactgtaaaggttacaagcactttcacatacacattatgctattatcatcaattctatggtgaagaacggccatgggacattgtgggaagggcacaactttggaacgagggaaatctgggtttgatgcctcctctccctgatagtggcctgctccttaatcctgagacacttttaaaattattttttaattgacacagtgtaattatacatatgtacaaggtacaatttgatattttggtacatgcctgcattgtataatgatccagtcagggtcctcagtgtatccatcatgcatttatcatttcttcgtggtgagaatcttcaaaagcctttttctagctactgcgtaacatgcaataatacagtattttactattaaccatagtcaccctactatgcaattggacaccaaaatttattcttcctatctaattttaactgtatacccattggctaacctcttctcattctttctttgtctttttcccctcccaagtctctagtaaccactgtcctactctctgcttgtaaggtaattttttttagatcactcatgtgagtaagatcatatcatatttgaatttctgtgcctggcttatttcatttaacatgatgtcctccagactcacctatgatgtctagtatttttctgcatgtggatatccagttttcccagcaccatttactgaagagactatctttttcccaatgtgtgttcatggaatccttattcaaaatcagtcagctataaaagtgtggatttatttctgagctctctattctgttccattggtccatatgtctgtttttatgccagtaccatgttgctttggttactatagctttgtggtatattttgaagtcaagtagcataatggctccatctttcttctctttgctcaagattgccttggctattcaaggttttttctggttccataaaattttgggatttttttcttatttctatgaagagtgttattggtattttgataggaattgtatctgtagattactttggttagtatggccatttttaatatcaattcttctaatccacaaacatgagttatctttccatttatttgtgtcctcttcaatttatttcataaaagttttgtagttttcagtgtagagatttttcacctccttggttaagtttattatctttttgtatctatagtaactacaatttttgtcttgactactggatatttcactcttagtgtgtaataatattactgatttttctatattgattttgtgtactgtactttactgaatttgttaattagtttttagtgggatcattagggttttccatgtatatgataatgtcatctgccaacagggacaacttgattttctccttttcaatttagatgtcttttttttatctcctgcctaagtgctctggcaagtatttctagttttatattgaagagaagtggtgaaagtgaacaggattctcatattacagatcttagaagaaaagctttcaactttttgccattcagtatggtgttgtgggttttgtcatatatggcctttattgtgttgaagtatgttccttctgaaatgagagaagttcccccttttccacttgcagggtgttcaacagggatgtggctctcttcttcagtgccccactgctcaaacccctaggggggacatgcagacagatagttgcagaggtcatggggaacgtttttgggctccaaccccaaggcagtgtgtaggggtatttacagctcctgaagcccgagttggcatgtgttatggtgcactctttcagctttgccatgtgcaggcggctagtgttaatcacctcaattagaccctctgccttatcgcaaggacagagggttttctgtatcctgggttcttgccctagtgtactggaaaaaatcggatcacatatgggcttggagaatgagtgcaagattttattgagtggtagaagtagctctcagcaagttggatggggagctagaagggggatggaatggaaagattgtcttcccctggagtcaggacgaccagcagccggactttcccccgactggccccagctgaattcccctcagtgttagcgttgttctgccgtcactgacctgccagtgtctgctggtgtctgtcagtgtgttcttctgctcctctcaacattcagctgcctgtgtctgtgcccgctagggtctcagatttttatgggtaaaggatagggggcatggtgggccaaaaggcaacttttggggcatgaaaacagagatgcctgtcctcatttaggtccatatgcacaggcccaagaatggagccctccatagggatcccgcacttctctaaccagcacttccctcccctccctcccatatcatttctatctccaattgatattgaatctttttgatgaaggaatattgaactgtactgaatgtttttttagcatgtgttgaaataatcacatgatgtttttcttcctgataacatggtatatcacgtttattagtttgtgtatgttaaaccattcttgcatccctgggatgaatccaacttcatcatagtgaataatctttgcagtgtgctattagattgttagtgtcttattgagaatttttacatctatgttcatcaatagtgttgatacatagttttctttttgtgtcatatccctacttggttttgaaatcagggtaatgctggacttgtaaaatcagtttggaagtattccctcctctttaattttctggaatagtttgagtaaaattggtattagttcttctttaaatgtttggtagaattcagctgtgaagccatcaggttctgggctattctttgatcaaagactttttattactgattgaattttcgcacttgtgattgacatgttcagattcctttttttcataatttaattttggtaagttgtatgtgtccaggaatttttccatttcttctatttatcaactttttgacatacagttgtttagaatagtctctaatgattccttatgtttctgtggtatcaggtgtaatgtctcttttttcatctctgattttatcattttttcttaaatatttgtcagttttatttatctttttaaagagccaactctttcttgttttttatttgtttatttatttttagtctctatttcacttatttctgttccaagcttcatggttttcttccttctctcaattttgggtttagtctatgcttgttttttagttccttgaagcatatcattaggtcatttattagaaatctttcttttttgatgtagggttttattgcataatatttcctttagaactgcttttgctgtgtcccataggttttggtataatatgcttccattctcatttatctcaaggaaagttttaattttccttttactttcttcattgactaattgtttgattcattgtttgggagcatgttgtttaactttcatgtatttgtacaaagtttctgaagttttccttgttgacttcagttttataccattgtggttggaaaagatgtttaatatgatccctatattcctaaatttgttaagccttgttttgtggtctaacatatgatatatcctggataaagtctcatgtgcagtttaaaagaatatgtattatttagccattggacagactgttctgttaccttctgttaggcccatttatggaacaatttaagttcaacatttctttggtttttcggatgatctactcgatgttgaaagtggtacgctgaaatcctctattgtcatatggcagactatctcttcctataggtctcctatttgctttatatatatgcatgctctagagttgaatgcgtatataactattatatccttctgttcaattgatactgttattattatataatgatcttctttgtctctttttatggtaacttaaaagctattttatctgcgataagtttggccactcatgctcacttctggttcccacttgcatagaatgtgattttctatctgtttactttcagtctatgtttgtctttaacactggagtgagtctcttgtaggcagcatatagttggttttttaaaaaaatccattcaaccactctatatattttaaatgagtaatttaatccatcaacattctaggttatttccaatagtgacggacttattcgtgtcattttgttaaggattttctggttgttttataggttcattgttccttttctcctcctttgtcttttacctctgtggtttggtagttttctgagttgctaagcttagtttgtcatttgttcatctactgtaatttcttttctttttgattaccatggagttaacagaaaaagtattgtagttataataaactattttaagctggtagcaacttaactttggtgatatcaaaatactctagacattttaccaccaccccttacaatttatatttttgtgccttaatacttacttatatattatgtgttccttagccactaattgtagctgttatggtttttagtcactttgactgtaagcttctacactagagaactgagagatgtacatagcacctttacataaatggaggattctgacctgacagagattttgccaggcccttgctgctctccagcacacttctgtagttgctctgttcaaaatacagttactttttgttttggtccccttttgtgggagggacaaacaccacataactctagtcattcatcttgctagggtctctggcagtgctcctcaaaaacttctgaaaattctctatggtcaaattttctcatctccagaaataagaaatgtaacttcaccaagttttatacaattaaaataatgtgtgtaaaaatttccagcaccatgcctggtttatttttgggaaaagggcaaccacaatctatggaagccaagttccccttgcctgtcttatccaacccattttctctgtgtctagaaatttaaaatatggactgaatcaataaaaatgtgcccaaccaaacactcagtgatgataaagccattgttcacattgttcgtgttcttgtgagggaaataatattacagtcttaaaattttattactcatgggaaagaaagtacatatttcacactgacttttccttatactgtcttgacccctctaaacatctacttaaaattgagatcaaaattcggttttattcatcaaggctatagatttgacattttatatgtcaaaggccactgaaaataggccctcgcatcacctctgggctgcataaccagtactatttggatagcatctctaaaaatattgagggccatgcaatatccttgattgaatcttggaacagaagagggacatcagtggaaaaactggtgaagtatgagtaaagtctgtagtttaggtaattgtaatgtatcacagttaattttacttctgacaaatgtaccaggattctgcaagatgataaacttaggggaaactgggtgagagatgtacaggaactctctgcactatttttgtaacttatgtgtgtctaaaattatttcaaaatcaaaagttattttttaaaaatcactgaggggaaccaagtttcatatagctgaaggaaggatttacatatatgtaaatgggaagagctagaatgtaatctatggtgttgcattggaaatggagggagaagactttattcaggaacaccatgacttgttgattttaaggtcagatccagatcctgaaaaatgaccttgtaagccatagtagaaagttggaactttgtcgtgagacaactgctcaaaggctgtgatagtttcccaggtcttttgtctctaccagcaaatcatgcagtgctgggcatacttctaagaccatctgggtcttacctgcaaatt

SEQ ID NO: 1521 - DNA, 8503 bp, Homo sapiens
gtcatcccacacatagtatataggatctgaaagtcaactctgcaagagacacagacagacagacaacaaactaggagacagaaacagaaaagagaaccaaagtagaattcttgcagtgaaactttaagagaagcataaaaagccaagagatggtgaggtcaaacttgatgaccatcctattttgtcaggagagtacaaaataagaaacctggactcaggcaggtctgagacagcataacctacacacaaagaggtcatgtgagcaacacttaagagacagctccagagagctccttcctgatgtgtgaccttgcataagccacttaattttttttgtgcctctttccttgtctgcaaaatgggacaatgattgcatttatctccaagcgctgctctgatgattaaatgagttaacacaggtaaagaacttagaacagtgcctggtacatagcaagtagaatacatgcttactgcattttaggttttttattttacaaaagaatttgataattaactattcatctataacaagtagattgacataagtgatattcaaagcttttcccatctcaaacattaaaaatactctgtttctgtggtcagggtgggacctatgagacagatattaacaactgtaccacaaaataagaaagtctttgaataaggaagcagaaacatagactatactttgaaaacacctaagctgcaaattatatgcagcaaagctaaatgaatttataaacatcttattgaaagccaaaaaacttctagcaagcaagcaagcaagaataggaggacttgcacattaaccattatcactaaattaggatatgtgaagcaatattgttacttcttttgtttttgagacagagtctcgccttatcacccaggctggagtgcaatggtgcaatctcggctcactgcaacctccgcctcctgggttcaggtgattctcctatctcagtctcccgagtagccaggattacaggcgcgcaccaccatgctcagctaattttttgtatttttagtagagacggtgtttcaccatggtggccagcctggtcttgaactcctgacctcgtgatccgcctgcctcggacttccaaagtgctgggattacaggcgtgagccaccacgcctggcctgttatttctttttaattagacttccgtcccaactgttttaattaatgtataaaaccataataactgttttcataagtttactcatgacttgggcctagccctattcttcccacaattccttcagtatttctaaccatcttctcctaccaaaaaaagattatgaaaagaactttcatggatggggtagactgaaatagatgttgaagtcaaaatttaagtaataaagtaatgtagtttttaatcctttatttttatttttaaattaattttaaacatccatttcaattctatagtcaaaagactcaccagcaatctctagggacattattaatgacactcttttaacagacttaaaaaagtcagaaactatactagaacttcttccaatttactgtcgaccttacattcctctccctgattccaaatccagatttgtttctacaaacaaaggaactctgggttaactgaattactgtctggtgatctcagctcaaatcttaggtccactttgattagccacatgaatccaagcaagttctcaaactttgccgcaccctttccttttaatagagttttctgtatattaaatataaaacatattaaaacctaacacatgtgaaaattatatcaggtcatgtatataaataagaccaaagatgttggataaatgaaatattgcatcccccacactctcccaagaaaacctgaacacactcaggctgaagagtaatgaaaacacacttttattagagtatgtgaaagttcaggggaaataaaaggtagtcataaataaagaagactagtctcacatccttcatttaactcacttctaaaactgtaagactggggaattaaaaagtgtttaagaaatgacaagaaattaaagagactatctcttttccccttccccctcccatgctggggtctcttactacatttcttccaccaccctctacacctatctagacaccctcacatcctttcctttcccttcattttggtcagaagtcttctgttgcagaccattcatctttggagagttaagaggagccagggttgaggtcagatgagaggaaggaggaaactagctgattgaaaccttccccaggctgcagaaagagaggtagagaagacctgtgagtcagtgagggctcagtcagacatttcaaacagagcaggattagtgcagtgaaataactcattactacatttttggaagtgtaaattagacaggcaaggtgatcgacccagaaatcagaaaactgtgggaagctacagctaaagcacagctgtctacatccccaaagctggagacaccacggggtcatagagcccaggaagctgctgccatcattgctggtacccttgctacactgcctccaccacagccagaggaaggatcctctcttccctccttacttccaaacatcacacaagtatctctctctgccctgctggcaaatgcagttcccaggattacaacacagtgattgaggaaaaaatctaaaatgaacaggcattgtgttaaaggtcaagaaacaacagctggtacatccccatttttcattatttcactgtagtcatttgttttgttttttctctctagcttaacccaaaaggataataaagaagtctgaaaatcaaggtaaaaagtctatgccttggctggagtgtcccctgtatcatgtatctcaagagcctaaacatggtgggcaaggcacaagaaggcctgggacctgccccaacaccatagttaaaacttaacatcacatgacattttggtcccaatggtggaacagtgagggaagctcactgtaaattgcatcacttttgaggaaacaaaagactatacattgctttgccttgatcacctttacattcctcacacctatcatatagttctaggaacctagtaaataaatgcacagtgtttccttattaaaccttcttttttttttctttttgagataaagtctcgctcttgtccccaggctggagtgcaatggcgcgatctccgctcactgcaacctccgcctcctgggttcaagcgattctcctgcctcagtctcctgagtagctgggattacaggtgcgcgccaccatgcctggctaatgtttgtgtttttagtagagacagggtttctactaagcgtttctactaaatgtttctacatgttggtcaggctggtctcgaactcctgacctcaggtgattcgcctgtctcggcctcccaaaatgctgggattacaggcgtgagccactgcacccggcctattaaaccttcttaatcaggattatagccaagtgggacttggaaataagacttggtatccctgaacatagtaatatatgagtaagcccagcatgatgtggtctccaagttataacatcatcttgccctcttccatctattcccccatggagtgtcagcataatcctttaaaataggcttcagatctctctctgtctaaggtaagaaccctctaacagccacacatctttctcagagtcaggttcagtgtccttccaatggctcctgttatctctgattcatctatttttccagatgatcacatctctctaatcctattggctccttactattcttggaacatgttgcaatggctttttaaaaatataccaactggcgagactacagtccccgattattcaatcaaactctattctaggtgttgctgtgaaggtattttgcacatgtaattgaagttcctaattgtttgaccttaagtaagagagattatcctgcataatctggtggcctaaattaatcagataggatttaagagcagggctatggcttcctccagtaagaagaaattccacctgtagacaacagccttggcctgtgtccttggacttaaagcctgttcatactattttcttcctgactgcctgccctatacatttctgacttgcttagccagcccccttcatcacctgaatacattcctcatcactgacctcagtgcatgtgtacttcactggctgaaccctcacttagcacacatgccaagtattctcccacctcagaaacatttacacttctctcttcctgaaaaccctctgataggtttggatgttttgtcctctccaaatctcatgttgaaatgtgacctccaaggttggaggtgggcctagagggaggtgtttgggccatgggggcagagccttcatgaatggcttggtgctgtccttgcagtagtgagtgagttattactctatgagttcacacgtgatctggttgtttaaaagaacctgccaagtccccactctctctctctttccatgtaacacatcagctcctgcttcaccttccaccatgattgtaagcttcctggggcctcagcagaagcagatgctggcaccacacttcctgtgcagcctacagaaatgtgagccaaaatcaatgtcttccctttattcatatccagtctcagacaatctcttataagagtgaaaactaaatacatcctctttctctagattgatgcacgggtcacttcctcacctccttcagatatttgctcaaaggccacattctcagagacaccctctcaagccactcttaaaactgcagcttctacaccttgatatttcctatctccgttcagctctatttttcttaacagcaccatgtaacacagtctatgctttatcagctgtcttcccctgatagaatccaagctgcacaaggatagagatttttgtctcttatagtcattggtatttgtagtacctgacatatagcagttgctcagcaaatatttaataaataaatgaacaaatacaactatgaattagttcagttgatagaaatggtcctctgccttcatggtccagttaacacttcaactcctctgttgggaccaaaacccagccctaaactctagctgccttggttggaaacttaagactaacatttgtcagcaagccacccaaaacatgtctgctaattctcatacccaaaatacaggtttggttctttctcgagcaggaagacagtccacaacaccaccaccaacacttctgccactggtgagctcacagacctactgggccttcctcataaaaacatctgaccaagtatgttttctattcactggattgtcttgggccaaggttgctatgctagaatcagatatgtttatcttctcccgatcatagtatgctatagttacttcttccttctcactgagctctctgagaagtcaaatttctcagttttagaccaactactaaacaacttatatttttaggagtttaagattgttttatgtatctagaaataaacaaacactatttcttggatgactcagcctttgaatttggtttttaaatttttaagtcaagtctagttaggttttgttcccattcatagtgagaatatggggtggaaaatgaaatttactttacatcctgtggttagataacgttcagtaggggctgatagctaatccagtattgacacctgaagttgtgaacaaaacctctcctagaaaacctagaaggccgggcgtggtggctcacacctgtgttcccagcactttaggaggctgaggcaggcagatcacttaagctcaggagtttaagaccagcctgggcaacatgaaaaaaccctgtctctataaaaaatacaaaaattagccagctgtggtagagagtgcctgtagtcctggatgcttaggaagctgaggcaaaataattacttcagcctgggaggcagaagtttcagtgagcggagatcacactactgcattccagcctcggtgagagagtgagaccctgtctaaaaaagagagagagaagaaaaaagaaagccttgaaataatttatcctctttattgactactatacaaaggaaaagccaagcagttaaatgtagtacctaaaaggtacctcacagccactaaatctgaaaataatacaaagtgcttctacatctctctggaactcctttttactgaagagttctttcaaagtagaacaattcatcaatttcactcactaatagaaagacatttaattagtccttagaaacaggtggataatgtataattgttaattctctttatgtcttattcccacatattctattttatatgtgctaataggtattaataggaattctacagctttgaaaatgagttgaaatatccatattagtttccagctccactggtggaatgaggaatatggtcatgtcaataaacacacattggggtaggtaaagatctcttaaacatattccagaacatgaataatggaaaatattgatgtattttatgacatcaaaattgaaaattttggaattcactatcaacgaagttaaaactgaagtgatagattgggtgaaagcatgtgtaacacagataatagaaaaccgtttctcaggaatgcatttctaaaactccatgaatgtttttaaaagataaacaaatagaaaaatgaatgcaaaatgagaacaggaaattcacagaacagctcaaatgataaacatgtaaaactatgctcaatatcacagtatttaggcaaatgtaacattagtaaaatggccctagttttgtccatcagtctcaccaaaattcaaaagcttgataatactaagtttgacaaaggtgttaagaaataagtatcctcattatttgaggaagtataaatgggaacactttagaaagcaatttatcagtatctattggcatttttaatgtatattctttttgacctagaaattccacttcttggtatctatatactcgcatgtgtttgcaaagagactttaatttctgtattcttggaatggctaaagaaaaatatacataggggaatagttaaataaatgataatatacacattctgtgtactcataacaatggagcatgaaaaagcagatctagaacacagagttaaaaacacagtatgtagtggtcctatttggatttaaatacatacaacaaacctcagcttttctgtgttttcaaatgaatatagaaaagataccaatgacactgattacagtggcttgttctaaaaacaaaaaaacactcagattgaagcggcctaggagggacagtttctaaaaaatgaatgttcattttatttattcctgctgaaattctcacagtgacagatcagtcatattacttttataattaaaatttgttgccaaaaactagagaaaatatttaaaaagcaaactctttccaccttgactggatataaaaaggtatttaattgattctcctatttcctcagtaccttactaactcctgttcaacagtctagctcatgtgtaatgtaatttataaagcctgtcttgactgatccctaatcatatatattctgctcccaattctgtatttattcctctaatatggttttttaactcattgttttatataaaaattgatttacccctaatttgaatggcccctaaaacaataagcctttcaagaacaagaaatctgcatctatggtctctaacatggggaccagctaatgactgaaggagtgaatgaatgaaatcacactttctatagctcctcttcacttaaatttaattacaagcagcccttgtcttcctagatgccgaacaagatttttgactcaagtcttgctcctcttgtctgtcaaacttaaccttttaaactctgtttagacccccagtcctgggtaggtcctatttgtactcttaccctctccttcagcacatccttcactctcttacttgatcctggaggaatgagagagtattgtatgatggcgttagagagtcactaaggaaatcgttgaagacaacagctaagtcaaacaaatctttgaatctcccacatctattgcagcgtctgtcacttggtaactgcatggtgaatgagtgagcgagcgaatgaatgaataaaaaatagctcaggtcaagtacacacagccccaaagtcatgagacgtaccactttctcaaggaggtcctccctgatcctcaacctagaggaacacccaacaacccaaaacttatattctgcaaataagagctaacaattcttttgcactagtaatataaatgtcacaaattgcacaaagtgaaataaatttaagttgtagagacatcacctaacccttcctgaaaaactattaccttcatttcatgtacaatttgagcagaacaacgtaataaattttatggattccagagtcagacacctttgagtttgaatctttcatttactgattgtaccactttatttgaagagtctatttactctttatgccttcttttttatcatctgaatgaaatgtaaattcaagcacctttctcaaggactgttgtgggtcagtgcagacaaa

SEQ ID NO: 1522 - DNA, 3171 bp, Homo sapiens
caaattttgcagacagtttgcttttaccctgctatattaccagtgtggtattggttaagtcattaaaactcttttggacttcaggatacacccacataaaatgaacttactttgctgatatctcttgaagcctgttacagtggctatatgacactgttttgatgaaggagacatgaactgacatctctaagggggtgggggagagaaagggatggctttctggggagctttttaaatcctgatgacgctgttctttctctcttctttcctcaaatgtgagtacattgagtggcacataagcagctatttttaaactatgagaaaaggccaagaaaattgcaaagaggatatctctaacatggttgatttgctcaaaccagctccagtgacaagctctctagatttcttcttacatgggaaaaatgacctcctctttgtttaaggcaatattatcacagttttcttaaggttttctgttacttgcagcaaaaatgcttgctcatggcaaggtcattatcgacctcctcattattcaatccaatagtcaattcttaatattcaccttaattgaccccacagcatcatgtagcataaacacttcctcttcttttaaacactcttttcacttagcttccaggaaaagacactcctggtttaccaccaactcactggctgctcattattggtctcctttactagttccttttcaactccttgacctcttagtgctaaaatgccccagggcttcaattctctatctagattcactcccttggtaacacccttccatttatatctccagcctgtacctcgccagtgaattccagactaatacctccaacagtccacctaagatctccactcagatggctaatcattcaaatgcagcacagccaaaaatgaattctgagcttcccctgacccacaaaacctaggctcaattgaagccattttatcctctggttgctcaggccaaaaactttgaatttatcctttattcttaactttctctcatatcccacacctaatctgtcagcaaattctattggctctaccttcaagacaattccagaatgagctgacttctcaccacctcccttctacttctgtggtgtgagccactgtgatctcttgcttggaggcagtcacctcctaactgggtttgctgcttccaccactgaccacctaaggtgagctctgagggcagaaaccagaatgatgcttttaaagtctacagtcaagtgactcctcactgaaaacctcctagtggctcctcatctcattcagtattgagggaagcaatgaaaaattatatttctaagtcctgtgctatttaaatcgtaagcttttacattctgctggttgcttctctttttttcctcagctttttattttgaaaaatgttacacctacagaaaagtgccaaaaatataatgaacatccacatttccttaatctagattcacccattcttaacattttgccacatttcctttatctttctcgatatatatctgtatatatatatacatatatatgcatatacattttctgctgatccatttgaaagttgcagtcatcatgctttatccaaaaatatttcagcacctatatcctataaataagacattctcctacataactagaatgcgacaattacacttcagatttttatataaacacaatatgattacttaatatgcaatccatataaatttcttcaattgtacctataatgtcacataaacccaggattcaatcaagcatcacacactacatttaatgtttctttagttccctttattataaatccttcctttttttagttttatgacattggtttttttttttaagaagacaagttgtttttttgtagaatatccctaaatttctatttgcttgtttcctcatgcttagatttttgacaagagtactaactaggtgatgtttagttgctcccctttaaatgacatgtttttaagtcaataaaataaaacaagtaataccacaatcctatctcctccatcttagagacccatcctagcatttcatcatagtcactcagtaaaatattcttctcttagggtcggctttgagcatgtggtagaccttgatgaactctccctggttcaatggagctccagaaccaggaaatataactagaaatgttattagagataaaaatgcctaagttgatagacttttctatttttagaccacaaagagacttctgacatagtattttacagtgaataccaggctactgagctcctctgtctactgtctaaattatttttgtttttaattggaaaaattaacacatacatataagaaaacaagtaaaacaatccaatgcatacaataaaattaaatcttcatcttaatccaaatcctcccatttccacaacccagagaaccaatgctagcggtttcttgtgtatctgttaaaatactgtttacaagcatgttacatacagctctccatcttgcttgttaatggtagagatctttctatgttagcacaaatatatttacatctttctctttagccaatattccatagactcaaacatattcaaatcagccatattgattcaaattatgaatcaaccataatttacttaaatgatctccaattgatagacattttttgctattgctgttagaaacaaagctggagaaacatctttgtatatcacttatttaaacacttctcttagaataaatttctaggtgtggaattactaggttaaaagatgtgtgtacattttcagttttgttacatagcatccaactgccctctaaaatcattatacccatttttctctcattcataatatttgacattggcagtttctgtgcccttcacactggatattatcaaatatctaaatgttggtaacctgataagtatctccttgcttggatttgcatggttttttgttttttgtttttgtttttgctgtaagtaatgctgaatattttttatatttgtataatccatttatatttattttctgtgacctatttctattcttttgcctgtttttccacagttattatttttcccacattaataatcaactagtgctccttcagcttgaaatgactattatggaaaataacatcttttctttgtcaaagaaatatatgaaccacttgagatttcag

SEQ ID NO: 1523 - DNA, 1967 bp, Homo sapiens
tcagcaatcgatatgtcatttgggtagagcaactcaacaatgaaaacagtgggtcttcccaaattagaaaaacaaaaaggtgaatgaacaaatatgtatgagtgtccgtgaagaggcgtcgtgttaggcttcgtggagattacaggttcatgtaggatgtggtttccgctgccctacggcagctcagctggggagacataatccagaaaggttcaaataacaatagaagatttaaatagcatttcaaaatagctgttattaatagaggagaacaaaaaccaatctgtttttgcaagggttctcctaaaaatgttaacatcattctaagctgtggagagtggattgaacatcagagaccagtcattgggttctagaggtctgtctgtaaatctgtctggatctgacagaggccatgtgtgtattgcagattggccgcctcccttcagttatgcagaaatctctgcactggctggaagagcactgtcaaatgttgtaagcattctaaagttcacctttgtgggtcagaaacacatcacccctcacccttctacctccaacagaattccctttatgaatgtgatagaatggaggggaaagaatgcaagtcttgctaagtggactcaaggccattttcacaaagagcactgaaaatatctgctctgggaccccatggagggacttgcagttttcctggaacctcgagtttttggaatactgtgctggcatcactccagaatcactggacctgtacaacatgctgattccctgatgcacaggcgatccaggcttcattcccagctttgatgagagcaccagcctcaagccttgttctgtgcccacaaggaaatgaaagtaaaaattgatagcaaacttcttttaactaaaccatagtctttaaagcccagaatcaggcttgtttcttggttttggtagctgtaaatgagcaatttatgctttttgttgttattgtcattcactggttcattcttttcttcaagaaggttttatttaaatttgtgtaattgtgaaaatagcacacttgttaaagtattttgaaaataaggaaaagcagaataaaaatgtacccagtgccactatttacatttcagtttatttctttccactgttttaaaagatatgactatactaatacttctagtcctagaatccttgcctcaccctctccaagatggttgtaggatttctgggttgctgaggtaatgtacagttgaaaaaatgtcaagatgtgtcaggtaagctatatctgctgttggcctaaggacagatattttggtgtaaggatgcctaatgtcttagagaccgtgtaagacctcgatgacttacccagctttccccagatcggcctcacaaccataatgccatgtgcgttcctcaatgtgctagcccagtatatttcttccaaggactgctcagctgttctaaaaaattctggtcaggggtggtgagagatgagctgcctatgaaggagacagagtgtgcttatttgcactgttttcatttcctttgcacataatttggaggcacttcctcaattgggacagtgtggttaatttgtggaaagctcctgctattagcattggtctttcctttggccttgtcaatctagatacattggcttgggaaattaggcatgctgacctcagttgcacagccctcttcctccttcttttaccaaagcacatgatttagccagataacaactatccacaccacagagataattccagcaatttggcagggggaaagttggtaggaggatgagtgaagggaggggaggggaaaacagcattaaaggtagcctcaagaccatggaggcatctaggcatgaagggaggaggcctcagatacaggagcgaaggaaggcagataattggtggcctgggcactcagcagggcagtggttgccttctccttgactttgagtctcctgcctcatccatctttgc

SEQ ID NO: 1524 - DNA, 1841 bp, Homo sapiens
atggaaaaaatactaggtataccctcatccattgctcactagccatgctttgaatttgggagccttacaattacatagcaaagttgagtagctttaaatgtagaaagcaggtcagtgagtggctttaatgtggattcatctgttggagaagatgtggtcctgcatttcacatggccagcaaagggcaaagaggggacaatcactgagaaatgtgtatgttgggggaaagaaccccataagaaacctaccagaaaatgggcatcatccctcatatttgcaaagcctttcacaactttactaaacacttgaatgctctgggcatagtgaaccataagaaacagaggggttataacccacagggtttaataaatgcatggctattatagacaactggatcatccggcttttaccattggtagcaagaaaaaaaaaagaggggctttttagtcatactccctcctaccatttaaaaacaaatctatacataatatagataacaaaactatatttaggaagaagcgcttattgatgggccaaccacctgaaatgtattacctcatttaacaacctcaaaataatccaatgtggttgatgctgttttcatcctgggtaggagatgagagctgagtgagttaagccactggtcctgtggcaaggaagtcagatcaccactattctggatcaatttgtcaagtttcaagtgtttaccttgaatacaaaaacaacctgagaggcagctggcaacgaatacttcttcacagtttgggcatgagtcctgactaacatgtactaaattaccaagcatatctttaaataaacgtgtaccacagcaactctaattcaaacaacaatctttaatgtaataattacactggctgtgacacgagctcagccgagagtgtatttttattttaacaaggctgagtaagtacatgagtgtgggctgagctttttgctcgatagtcaatacttgaaagctggctccaacctttaatttaagcattcgcttgtagcaccaacagggctacagggtttctagtatcaaagacacaatcctccgtcctttcatggccctacttctgtaagcagcatgattgaaccgcggcaccacagaaacttgttttccctccttctggcagcgttaagccaaaacactactgccccattcatcttagcgacatcataatgaagtccctgaatcaatttatatcaagcaaagtgcagaaatccattgaagactcgtggcggatgcctttcatacatctctcaacaccatacaagaggcagagcggccgcacagaaacccaaatcataacacagaagagacctttgccgcatccaaaaagcttttttatctcttgaaataattaagggaaaggaagatactgagaatatctgattgtttctcgtgtttcttcatgtgccttaaaaatatctggcagcctccctccgtggcctcccggcaccttcagtagaaagaacaactcccgtagaatgagggtgagagcctgtcatagttcagaccccaccggtctcctctacatgccttgtctcctgcagtccccgacttgccttgctcactgtctagctttcaaggattttcacaaactaccatttgttggcaataaccttcctttgcttcaaagctcagctaagccttcacttcttccaaaaagctgttcctaacccctcagtctgatttgtgctcctcctctgtgctcctatcgtctcctgcattcctctgctctagcatttacactatgtcatgattttatttccaccttgggccctccctggcctgtgagctccttgaaggcagggaccacttcttttcatctttc

SEQ ID NO: 1525 - DNA, 3129 bp, Homo sapiens
actgcaatagagaaccagggtagtggggcccacagtgctgagtttcaatctgttgctagttgctaaccaggtggccttggagaagttttttttttctttttttaacctttccaaacctcagtttgttcatcagtaacatgagaataattatggtacccatacatcataggactgttgggtagagtatatgagataatatatttaaggcctttaacagagccaggcacacaatcaatgctagaaatattagctgctcgtgttagtgttacttagagaagggaaagcaaataactgtcaaaagtcaataaaatgatactctaaacatctaattaaatgcaacctgataatcatagaactgtacatttatatgatttgaagcattttttcctaaaaagaacagttagtttctatgattaattatttagattacagaaacaaatttgaggactcactttaagaggacacgaagtggcaccaatggagatcagacatcagaggatatcaatgaaatttatgtctaacaggctaatagcactgagggttagggtcagggttctggaaattccactatattaaaaggaaatgcttttaaatgttacttagcagaaacaaatcatctcctttttcaccacttgtaaaataagtcacaaacataaaccttccacatctacgtgccattttagaatgctgtttcctttaaaagcacacatacaagccatccccatgaatgtgggattgtcactgggtcactagataaaggagatttataaaatctgtgactgcatctcctgtaagcatgctttgaagaagtaatctactccttcacccatgggtcctagaatatggcctgcacacagacaaatgtgtaagttgtaaggagcagttctgcctccctcagaggctgaaattctttcttctgaccaatcacatctcaccttactctttggtttccaggaacatttaaggattaactactggaaatcctgtaggtctataagcccatgtatttctattccctcacccactcctcaccctggcattggtttggcatccacctcttcactctatcttacttttggtcctaatttctcaacaatgatttctattaggtcaaccctactgtcacttatgtaggtcaaaaacctttgaatttcaccaggcacggtggctcatgcctataatcccagcactttgggaggccgaggcgggcagatcacgaggtcaggagatcgagaccgtccgggccaacacggtgaaaccccatctctactaaaaatacaaaaattagctgggcgtggtggtgggcacctgtaatcctagctactcagcaggctgaggcaggagaatggcttgaacccaggaggcggaggttgcagtgagccaagatcatgccactgcactccagcctggtgacagagaaagactgtcaaaaaaaaaccaatgaatttcaacaacttcatttgattcaacctatttttcccattgttagtttatggatttgttgtaggccagctcaaagcctccggaaaaggagaaaatatatgcatatagcaataatcagcaacagactggtttttatagatattcaacataacacaaagaaattaaatttaatacgtgtctgacctgagaaagccagaaataaaaaaatccgccgatgcatttaactttttttcttagggtatgccttgctttaaaggtgaggcaggtactaatctacaaaacaaatcttgccacctgacacctcagcctctatctctcacccctattttaacctcaaggcctcttctgtagaccccattatggactcctcaatggttagacaaatgctgatctaaacaaggattaattagaagtgagatgaaaacaatgctctgtactctgccttttccacactgagtcttatgactccaaacttcatcatgatctttggacccttgctgcacctttcttattgtcagcctctgctcttggactgcacttgtctttcttcccactgccacaccacacccctatggcctcctaagctgcatggctcctgccattcccacatctggacacactcagcatgactgtctctgctgtttccagccccactagagagagaccctcatcaggccaggaggccccagacaggcacctctgaccagccctgctgggacccagtgctggcccaccatttctcccaaagggagattcaatatattcaactgtcctgaagtctctactctacattggatgaaacaccattttaccatgacttagaaaatcaggatacggcttaaactgcgaggctggccattagagctgaggctcaaagcacatttcaaaacccaaaatggccactctgtcactgtcatttcatttttagtaaacctctagcctttcttttaccaccaaaaaacaagaagagagagagagagagagacagagagaaaagagagtgggagtaaaagggaaagagttagaaaacagggtgactttttctgaacaatggttgcattaaaaagtgtccttgaagcagagagaccactcaagaaggaaataacacctcaaaccagggggccattcaccaaaaaagagttcacatttgaagctctttgcaaaatgttttcgtgtgtctgctttcccttgttcattacaaaactgatgaaaaataaagatgataagtatgtttatacaaaaagaacccattcaataattcatcaccttgttggcttacaatataactactccaaaagaaacgtgttttcctacccactgaccatgaatggatacctgagacttaaatatggctcagagcattgtcttcccgcgcacgtgttgcggaactgtccccagtatgctgcccgtgctagttaacccaggtggggcttcagccttgatttgccccactgttctgtatcttccatctcttatgtctcccactacaaagcatgctggcgaacacccaaagttttgtttcgttgcaaccactaaaattcactagacacggaattatagtatttttcagcctagaatggcattctcgattaggggcaattttgtcccctagggtatatttggcaatgtttgaagacatttgtgattacgacaactaggaggggagtatgcactgacctctaatgg

SEQ ID NO: 1526 - DNA, 3422 bp, Homo sapiens
ataattgctattatcattatcctctgacctgagtatacctgactccagcatacctggccagaatgcattcaagatccccttctctcttcagttaatagatgaggtctttaattgactgagaagcatttgggagaaaaaaaaaaaacaatcaatgaggggcaactttgctaagtcatccgatgactcatgggaaatccggaattagaacaaaaagtagaggcagtttggtcagcagggcatggggaggacacgcatttaagccccatgtattttggtgtgtggagacgttgaaaaaagaggtagggagggtcctggaaaggaacatgaaagatgctgaaacctgagggcatcttaaaatcacaggttcactcagtgtcagagtgagatctgtgagaaccctcattctagtctacacaccgtgaggcccagagaggtgaagtttcctgcccaaggtggcccagctcctgggtggatgagcagtatttaagcacttgcttatctcctgattcaggagccactgactttttcctgccacctacccaatttctctgccacccagagggctctgtctgagctaaaagggtttatgagggtcgggcagggtggctgagcagccttcgcccagtgctctgaaaatgctctggtttttcaagtctgcagcctcaaagcgtagcctgcagtagttctcctgtctcaccttctactaaaaatgttcactctgaaacttgtaacagtggtgacctctgacaaacggcacatcccagctgttaacattattcggcttacaacagaagttgccctcacgacccttgtagccaggcccagggaggaggtgacactgtcagggccaggcctcaagaagaacaaagagaaaactcaccttggcactcaaggtctgggaacggctggtggctcgatcaggctccctgcaatcactcccttctgtaaccgtgggtcggagacatgaatgctgcctctggactcgccaattaggcccagccatggggctgcggagccccacacaaggaaaccctattagcaattagctgatggaggatcactttataccagggcttatttttagcacactgtcaccttttcactggggccaaaccttttgtatccaatccatacctgagttgcaagacattgcatttcaaacctctgttaattgacttcattagttaatgtgctgctccttgaatcccgggggtaaatgagcagatgaagaagactaatttaaagaaagtctgcagacaacagaggaggagggatgcccctgcccccaccctggcccccgtggaacccacgtcaaggagcatcagattctccccaggcttaactccattagtcatccctgagtcctctaatgagcttaggttatttcctgtttttccaggttttgatgaagggagctgtcataggaaatatgaagactgtgtctgtatctgaaccccaaagcagctctcttcaccagcacccccttgccagctcatttcagttcagttgtttcacctctcaggctccttgtctatacattgggaaaaattgctgcctcacccatttctccccttcacacagccagccaggtagttctgaggagcaaagccctgctaaggagagtgtgattagctccctggggtgataatggaagtcattcactctgctttttctttgtggctcctaagttatcaggacccttaagagccaaaatatatgaaaaatttgttctggagttttagccctctaaaggcctcattcattccacgtgcactgagtctgtgccaggttccttgtaagcggacaggtatagagaaatcccaaacaaggccccccaaagccacagatgagtggcagcatcatacaacttaaatgccagggcctggcctcatcctagaacagcctccaccccagcgtggggcaaggggaccaccgtatcaggtaacttttcctgaaggaggggccctcacagcttacagaacctttgcaaacaaagattcagccagtgaagaaagggaggtggctttcctaggcgttgaaaagaggatggggaaaggctggcacatctggggaagggcaagcaacactgttcggctggacatggtgaacaagtgtggacctgaagaggtgggatctgggcaggtgggccaaggccagactgcagagagcccggaatctttcctgaatgggaggggagctgagaggctactgggatttcaacaagggaagaagcatgatgaggcacacgtcttaaaaagataactgtggagagagtcaagggcggaaggggcctgggcagggtgagcacagatgcccttggaagctgctgcacctagcagggcttggggagcaagtcgcctgggcagggagtaatgggggcctaaacaatttcaatccgtcataacatacattgtgaagatatgcaaagctttagaagtgagatccgaaaagagaaagcaggcaaaccgagtactgggtgcctgattctaggaaggtgtcccggtctgccaagttccttcccaggctgagtcctgtcactgtcaaggcatcttcctggatttgtcaagtaaggcttgagctctgacagaccttctggaagaagtccattttcagtttgccagacttaaaaaaacagtaagaaaattggatcctagaactcactctggagaacactgaaatgaacatgtggggtcctattcagaacatgtttgccttgagtgtatggaatctgggtcaccttcactgaaagcccctctccctcggaggctaagctggatttctggggccctccacttctctccaggaagtgaaggtaatcatgcgtatgtgtgaggagtcagaggatgaagagtgaatgaatggaaaataactgatacagtgttaggctgggcacaggaaacgggagacccctaacagagttccctgattcttacatgcttgacatgtgtcccctcttacttcacagccaccaacactaaacacatgcacacgtgcatacatacatgtgcatacacccacatctcagttccaactctcagctaagagttggcatttgcattttgtgaggttttcttgggaggggacctttccagagagccacagatccccctacactcatctcttctcctcacctaccagcagggactggcttgggccatataagctggaggactcatgtaacttctcttgctttaaggtactttgctggaggtggagcaattaatccacaactcagcccagggaagcagacagcagatcgtcatttcactaatgagattgctgagccgtggctcggagtgcgtgggcctggccaggtggagacttgatgctggcaggaggggcgttagaatcctcacctacctaagcctgtggtggagcaaacagccctgcgggactcaatgcgtgtaacccttggattttca

SEQ ID NO: 1527 - DNA, 2031 bp, Homo sapiens
cagagaaggatgcaagagtttttctctagagtggggtaaagtgaggatagtgcctgtctaggaaccctggtctgggttctgaggatcaaccatttcaccaattcctgggtcaggctgcatgaatcactttcaagaccttgtattttttattctgtttactaagagatctgaatcaactagatgatcccaaagctaccttccagttctcagttttatgattctaagtgaaaataacccaaatcaaggtgcccctctgtgaatatgaatgaggcagttgccaacacactgtcatttgggggctctaaaaaaagaaataccccagcctctattggagatccctgagaatcttgccacctagtgattcttggatcaagcattaaggctgctaaaatgtactcattgtgtaatttgggaatgcttgcccattaactcattatcggccatttagtcacccatgtaaagaaagctatacaataaagtcagccaaaggttatgtaatttttgttgaggcagaacaggtcttaaatctctagcccagggagatgacagcagccaaaatccatctatactgaaatgattatggagctctagacaagatgagacaagagacaagctgtttagttaatgagaatcccaaatctctcccggtgaaacaggaatcagtggtctccagctaccatgtcacacagccacactcattgtgatctgccactgttattcacccctgcctgatagcttttgtcacccccaaaacgccccccaaaattcaccacctcgacacacgcagtcatttatgagtctcagaagagctgaaaacagtgtctgaaaacctcatgatctcactctgtccctgctaatacctaaaacagtccactgttccatttacacaggcttttcttcagcagatttacaaggtaacatctgcttcggaaacagatgtttatgccagaattctcttctgctcattaatgcttttccggttaacatctaactatctcactcattagttcttaataatactttttgtatccgagccatgccaaatacgcactctttagagctctgcattattgttgcttctgttgccgttgaattacgctgctgaataaaggaaaagtaaaaataagcccctctaagaaggctgctatgtgtcagagctctatctttgtgaactgaacaagctgaaatcaattaaaagtgtgtgtttagagaatgcatctcagctgtctaattgcaccacctctgctttagggccaaagtttgactccctgccaaattgccatcaaaatgggcgtccgtaagcgctgctgtactccctccgccactgcctgggcctgatggaagcacttgtgtaacgaaggaagcccagtgcaccccagggcttggcacacacactcccacttcccaggggcaatcctcagctgtggggctccggcagaagatgccatgaaacctctgggatgaaggtcctgggactagataaattattccacccgacttcctcagtcagccagccttaatagattgactacaggaagcattcgcatgatgctctttatttatccacaagcaacttcacataacaagaattaattcaggaaaggtagactcgacatacctttgctgagtgcctagtagtgcgttgggctgctaagtattttatacccatccattattagaaatgtaagtactgcttgtgtgtattcataggcaagggaaaagataaagtaaggttcattttttcctgatttgttcctacaagggtatatgttaaagtggtcttttaaacttgtttctacaatggcatatgttaaaaatggtctttaaacactttgaaacacttgatggtggcccccaagactagcttttatgtttccagaagccaacaccgtagtcaaacaattgaacaaaccaagatataaataaagctaaagttggtctatgcaataatggaaaagccagtcctctagggaacttgggccaacacaatgtattgtttgggatcaggagaaaggatgcttaataaatcat

SEQ ID NO: 1528 - DNA, 3068 bp, Homo sapiens
tattttaatgagctctgctacgttttttttttttaatgatagctttttaaatttaaaaagtttatgatatagaagtgataaagattttgtggaacttaggaatgaaaatttgttttaaactggttttaaatgatttagcagatattaatttccttaaataaaatattctcttttaaatattttatattaacattgcaaagtataagtaaaggcagctttaagtttatagttcataatatgcatcatgctgtgttctaaaattaaggacatcaccctgattatcattactcattcatgttctatatagatgcttttctttttaaaattaaagtggcactcagaattcaaaaaaatgactagccaggcaaggtggtatgtacctgaagtcttaactacttgggaggctaaggtagaggattgcttgagcccaggaattaagtccagcttggaaaatacagtgagacaaaacaaaatgtcactaaataggactctttagttacgaggtttacttagtatttttatttttagtaagaggaaaagcatggggaatcaggagacccaggttctagccctagctcagatttggaatcatgatacaacagaccctcagcatttgctgaggattgctcgtgcaactctacatattgatcattaagaaaatgggatggacattctcagcaaactaacacaggaacagaaaaccaaacactgcatgttcttactcatgagtgggagttgaacaatgagaacacatggacacagggaggggaacatcacacaccggggcctgttggagggtgggggggctaggggacggatagcattaggagaaatacctaatgtagatgacgggttgatgggtgcagcaaaccaccatggcacatgtatacctatgtaacaaacctgcacgttctgcatatgtatcctagaacttaaagtataatttaaaaaaaaaaagaatgctaaaaaataaaaaaaagaaaatggaatggattggttacaggaagagtgtatagatactgtcttctgccttgttgcttttctattttttttattttccttgtaaccttagaagtgaaggaaagtgaaacttatggcatatactggtatggtcttgcctggactatgaaaagtagactcaaatggcagaaactggaatttggcaccttctaaaatatttgtcactttagcacagacttggccatttattggcacctagctattagaaacataattgtcgctgatatcccaaatgcttctgtgatctttacactttactttgggtacccccttatgccttgcagaatctctagcattctctaacctttcttttgcttcttcttttttttttttttttttttcctccacagatgcatagagcccttatgtgtcctcctggccagccattaatccccacctgacattaagacaggctatactcctgtcttaaaatatgtcttcccttttccgggccccagtaaaattaatcattctcttagtcaacctggtaatgatctgattttaataacccaaattaaagaagcttaacttttgcactaatataggaaaacgtttgcattttcaaagattatcttattataaatttaacatactcagtggtctaaagatattttatgccctttttctaagcactgctttatctatgtcattctgagtatttctttcgcctacccctgccagccagaaatccaaaagcatgaagccaactgagaaccatcagccattaactcactgccctggcctctttcaaagtggccttgatactgagtaaaaaaaacagagttgcttagattacaaattgggttggcatagtcatcagcaagtaacttaaatagaattccttaaggtaagaagcatttttattatagaatggggaaaaaatgtttttacaataggaattgcagatttctacttgctttatataaggagcacatacatagaatgtcagaaagtctccaaagtatatacatattaaatataacccactgaattgtacacaaaattttgaaacaccaaacaacagaaaaaaagaaagccaggcccaaaacattttttttagagatggggtcttgctgtgttgcccaggctggaatgcagttcacaggtgtgactgtagcacactacagctttcaactcctgggttcaagcagtcctcctgcattagcctcccaagtagttgagatttcaagtgtgcaccactgcactcccccagaaaacatgtttaaaacagaaatagaacttttaaaactttagttttaattaagcaagccatatcactttttattcctatctaatgccatgcatacatgctaaaatcttagataaccaaaaattatgcaaacatatgcaaagaggtacaactaaaaagaattattctacatgtactgaaggagtggacagagaatcttcctactagccttctgtggcttcagggccagcaggtgaagaggggtcagtatcacactcagctgatttttcaatgcaggattgtagtcttagtaaagaggaaaaggaaagtgtctgttttcagcattctgatctaattgacaagctgtaattaaatattatcttttgataatggaaactttaccagaatagggatttttttttctattaatatatataaattgaatagaaacgtttcaatttagcacaatttctttcagtagtctagatctgctttttcacaagagggtttctatgagatgactgagctccaatgctggaagtcagtggttctcaaagtgaggttcatgaactagcaatattagaatacttaggagaattcaaattctcaaaccctatgcccaaaactctaaatcagcaatctgttataagctccaggtgatttgaggtaccctgaaatttgagaaccactaccttaagacatccgttgcttataatgaattaatttctttcctactcatctggaatggtactagttatctagagacatttcaacctagtacaatttcttttaatagtctagagaataatttttaaatttcagacagtataatttattctgagaaacttggaacattgat

SEQ ID NO: 1529 - DNA, 1747 bp, Homo sapiens
aaggacatgaactcatcattttttatggctgcatagtattccatggcgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaaaggtatggactttttaaagctcttaatacaagctgtcactttgctttctagaaagaattgtaacagattggcttatcttaacggacattgtcgtcaaactcaatcagtccaaggctccatctccacaccagagccagccaagagaaccagaacaatgtcagagacacaggacaaaagtggtttttggctatagtaaccatattctccaatctgggcatctgtttcaagggagtgaaaggagaaagtccatttgtctatttgcacatgtgtagtcagggttctcctggaaggtggtagcctcctccgatccagcctgtatctggttcattgccctataacacagccctatgttaatcataaagccaaagggcagggcagctttgttttctctcagccacaccccagtcaccttcctgcacttaaatctagggggctcctccaagaatctgtagccacaagttgataaacacattttcagatgggtttgttttgcatctattacaggttgaagtgtcctagttttgctctcaagtgatgacattcatccagagcatgttccaaatctgcccatttcccaccccatctgggttctgccttaccatatttttaagacagaaacacaacgtacagcaatactaagccatattctaatgacaatagttagataactttttttctgatttcaaaagtggtacatgtttaaagtggaaaatgtagacaacttaggaaaccaggaaaggaaggctgcagagtgaccagcacttatggcagcctgcctggcagatggagagtgcacgtctcggtggacatctgtgtggggtcagcagggatcatgttcagctcagcagatgtcaggagacatacagcaaagtctgagggctggtaagaactctcccgcttgacactacataagccctgagaacttggttccaactccagggaaaagggtggggggaacccataaaactgaaataaaaatcataacacagtagaatgacacttgatatagaaatcaatttcattggtaggaagacaaagaacagtggagtctagtttgtattctctttccagctcctttggcctctgattcccaacctctggtgcaccccaccaccagccttttccagtggctcagtttggttcagtcgtggtacctggtttgagggatggactacattctttaggcaccccgtgggagctagccctacaaatcaccatggaaactgaagatagagtgattgtccatgctggtcttagaggcaggtggttcccaggtgaaggctgggaaaagtcactcctacaatgatgtaataactctaccaatggccctcggtttctgaagatttgcttcccttaattctcctcactggaattgggggattagatctctgaaagcagagatgatataaaaacatatataacatatataaaaacaaacaagcaaacaaatagcccaatagggccatgagtcttggtagggatgtaccagtaagaaagagttctggtttccctaagccatggtgcca

SEQ ID NO: 1530 - DNA, 2134 bp, Homo sapiens
actcccgagggcctgtctggctcaaatgctttgttactatgatcgaggctgaggcaagcaaccctgggccatgaagaccaacccagcagcatgggttgggggcatgggcaggatttctgagggcacagtgggggtaaagagtcgtaggcccctacctgttatgaatgtacttgtacgaccctgtcattgctcggcatctgcagtatggagaggctctccctaaaacactcaggattgtttaacaacaatgcgctcctctgagctctgcgccttccagagctcacaggcctgcagggagagaggcacacaaacaatcacaagccaaagctgtgatggaagttggcacggacaactggatctcccctgcccccagctggttgcccccaggccaggcctggttttataccctcctcagttccctttggcacccagacaggactagggagacagtggccccagaagcagtttaaaatttttttattattttgaaaagggattacattcacatgtttcaaaatccaaacaagataacacagcatagagaaagaagcctttccgccttcctactctgtaaccctgcttttcgtttcctgtgtgtcctttcagagctccttttgctttcaaaagcaaatacaaatacgggcagcttctgaatggatggccaagtgactctggagcttccgcgctgtgtgagggctgggctttctgtccctgttcaccctcgaacccaggcttcagccaccgcacggtgagtatccattggacactttcaaatatttatgaaacaccgatggattttctcagtccggagctgtagcttccatggaatttggctttattagccagaaagtcaatattttccctgggccaccgcagagatgcacatacttctatcttgcctccggccccgtggacccggctgctctgcctggtcagcttcctgctggtggatcacgacctttctgctactgggagctggcagggaaggactcagacaagccaaagctcagggctggagcaggagcttggggtgaggcagaagttttgtgcagactcactgggggtattggacaaacccgtttccctccctgagcctctgttactccacctgaaaacgaaaggtctggccgatcgctgagttctgttgccgcttgttgcgcaaggggagtctcccgggcttcccagactggggcctcctaagtgcggggctgggtcttcttttgctcctttctcacccccaacctcccacacatagggcagtttggcttcgggctttttcttcctcatagtacagcagatttatggctttgctattctgggaagcagccgtttttccgtgggatctaagggggccacggccggagagccaggacccccaggcctcatcccaggttgtccctggctcgtggcttcttgctagggcctgagggagcagctgttacaaagctgatgggattggagtctgatcaggggagagggatggccatagagcatggctgatggaaggttgtgaaaacagagctgaagtttccataaccctgaggtcagaacaagggcagcagtgagaactaatgagcttggctgtgatggtgcggggaggggagctgggggagggaggcagccaagagcagccaggcagggggtccacctggcaccaggggagctgtggtggggcctccagacccctgtgcagccttttgaaatgtgtgtgtgtgcattcaattttatgatcttaggatcttaaaaatatttacacatgtattcaggtaatccacgaataaattttcaccacaaaaactcaaacaaccagcacattacacaggaggctccctgtccttgcggagcaccctccaccacttcctatcattagcagtttgacacacacctggcagactttccccacagatcatattaatatacagaatactggccgggtgtcggggctcaggtctggaatcccggcactttggaaggccaaggtgggcggatcacttgaggtcaggagtttgagacatggcgaaaccccatctctactgaaaatacaaaaattagccaggcgtggtggcgcccacctgtaatcccaagctactcaggaggctgagggaggaggatcgcttgaacccaggagccagga

SEQ ID NO: 1531 - DNA, 1862 bp, Homo sapiens
tcctagccagaaatacacagggaagggaattctgtaaaatggagctcagcctagccaactgaacagattacgaagccacccctcctttacagatgtggaaacagcctcagagaggctaattaacacacccagacccacacagctagcaagggactctagctgtagagtctcatcctaacccaggctctatttcacatgctctgggaggtcagtgataccaacagctgggcaaagttccaggacaaagtttagggcaggttcccaggcacagaagcaagtggagttgaggccattaaaagcaggggtctggtattgaattggccaagctgtataatgtcccgcaagttagtgaacctctgcaagcctgagttttccactatgtgaaatgagttcatcatagtccctatctcacaggggttttagtgaggttgaagggagatgacccaaggattcagagagcccagttgcaacctgtaattcaagagctgtgtaaaagctcttaggactggatgacagagcaggagctatcattgcctaaccctaggagactcccctcagctccaaagtacagaagaagagtaggacagagacccgaggcccccctgcatagagctagttgggactaggcccagctcaggctgtggagtgaggcattaggagggctgcagaggcagatactgatggagtcagtggggtggaggggtgggggggcacctgtaaggcctttgaaactgagagctccctgaaggtttcacctgtacccacttcccccagctgaacagcagcctttcagaggaggtgggtaaggtgtgcttcctgccaccctggcagctccgggtgagtcagcgggactcccgggctgcaggacagcccaggtggagtgggaggaatgaagcagagccctcgcagcctgctttgccgcaggcagtgggggcaaatgcaccagtttcccagagtttggtgctaaatttagaacccatcgtcctagtgagctcaatcactgtttagtcagaagcgaaatccagggctgatgaaactcacctgcctgtcactgcccggctggcatgtgccaccacccatggagggtggcataggaagctgacagcatccaagtctgtgcctctgacccttgccactcctgctctgccccaaggccaggctgtgcgaccaccagggcaggtccctgaccctggcccttgggaccagagagcctcacacggttctgctgccttggacctgctgactagccgcgttctcctagctaggctaaatctccagctgttcttctgaaagcttctgctgcattctgaatttaacactgggagaaatggattcagcaccaaggttgtgaggccccagggatcttgcctatttggctttcagggatcagttatttcccaaggccagggcagagggctggctcaatggaagtcaggcttggggactgagtgagtacttattgtatgccaagccctgtgcgaggcctgtaaatgcaggagctggcaatccacagcagtattttaaaactgggaatcccaccccatcacaaaatcaatttagtggatcatgaccagcatataagaaaatgaaacaaaatagagaagatcagagggactgaaagtagaaagggtagatattattttctgaaaatgtatgtgtgtaggtgagtactagattgtaatatacaatgtatttgttaataagggccaaagtctagaagagtttaagaaaccctggcccagagtgggagggaagtatcccaacacaatgtaattgtaggtgtggaaagagaagagacctggatttaaatcctggatccacagctagccatgtgatcctggtctagacagtatctctgtcta

SEQ ID NO: 1532 - DNA, 3985 bp, Homo sapiens
tttccctctattttatctacccactctagggcaaggttacctgcaaaaagccagaggcatgggaactagttggctctcccaggaagatgaatgtccttacaggtaaagtgggaaggcccaatgcatctcagagagccagtggcaatcggacatctgctgtggaatggctccaggctggcttccaactggactaggaggtgggcatgcccatggacgcgcctgccagctctagcagaggatgatgcccggctgcccctctgtgccacaaagtgcgtttggagctggaagttgccaagcgcctgaccttgtggcttcactgtacagtccttgaaaggacggagagagaaatttaactccacctcggtttgccaacctctgggccactttaggcagcaaggctttgggcttgggctttgtggacaaacacttctaagtgtccaggccacattctctctctgtccttcctccccttttcaatccaagtgagcgttagtccctccgcaggattgcacatcacatggaaaatcctacccctggaaacaccacctgaccttagggtgccagtcctgaaaagttgaacaccaaagagggagaaattgatgattcacagttcttggcagaatttgttccctggggtcaccttcaggactggagctttgggaacttctggggcccaaggctggaggtgggtggaggtctggaaggagagggatgccgagggaagagggcaggggctttaccactgccacgcatctgcctgtcccggcagccctccagcctccactgcagccacatcccaacacaacctgtatacttctgcttgttcactagtaaagtggaaaaacggaaacatctatacatgtgggcaaagcgtctcacacacccagaacttcgcaaactcaatttagtcagcctgctttttacactcttgatttcctcacttgcttttgatttcaatattgataaaatacctactgtctcacatctttatggtaatagttgcagaatacattcagctgcttgcggggagttttgagtgttcagtcgtgggtaacttcccagggccacttctccctaggaccctcccccgcccctcttaatggtgggacttttcataatgtgcacaatactattaaaatttcatattagcagtgtgtatggtgaactttgtaatgggaaattcaatagctgctgtaaatattaatggaatatgaaatgaagccacagcctcgaccagccctgacagtaaaacggagtgagcatgtggcggccccggggcaagaggggcctttcctcttgtcgctctcgctttattacattagcgcgggcttccccgcgccggcgtgggctcagaagccgaggcgccgggtcacccatgacaaatgtccccgtgtctcgccaacaggccccgcctggccctgccactccatctgcccaacaggaccccggagagtgcttgcgggtgtcagtttcaggtaaagagctctcgaaagcgcaaagtctccaaaaaggttacaagggttccagcgcctccccaagtcacggaagcctgggccgccgctgcagcaggaagggttcgtacccggggggaggggaccaccccaagcgcgtgtgttaacgaaccccaagcgaatttcggggcttgaaagcgctaccggggcagccagattactacctcccactctcacctccatccctccccgccccttgcccgtcccacgggcctcagatttgggcgtagggctgggtagggcgcctgggaggagccagagggggcggatcaggccgggatttggcgccaggtacccccacccgcccgcgtcccggggtcgccagctgactccatgtgagcccacttggcaccggccccccgagggatcctgcgacgcgaggggtgcccatttgcagtgatccgcggactctcgaaccctaaaccccggggcccagctctgccccggcgtggatcttcgggaaaccggagcggaggctcgtggagacctgggaggagctgcgctgactggggcaggggacgcccagattggatcggttccgagctctcgtcgcccccgaggagggcacgacgcgctgacaaacgtggccgtcaacacctcgagctgccccggcgagttatttcaacagactgggagagagccgtactatttgagtggcaggcgacgcctttccccactctcggtatttatgttgcaccgacggcacttaggagagcttagttttagatgcggcattaatcttcacttgttaagagatagtctgtcagcctttaccaggctctcccactcccgacgtgcaaggccctcccccagcgcgcggccacccccaagctggtcctcgcaaaggcgcgcggagccgcactgccgaggagaggagcccggggttaaactggggcaaggcgagcgagccgcggacgccaggcgcgagcgcaaggttaaagtcaaaagctctgcctgggccagcactcaagacggtcctggcaccaacgcctttcatttttgcctgtttgcaagcggggaaagtggagtcctcaatcatagcgaggagcttttcttaagccacaaagcacacgggcgcaaacatcctcgctgctaactcagggcaattgtcttcctattttctcgttcctgacccccaagtttcaccggtgggaagtcatcgaagatctcccttttaccaccagctctacggggtcgcttttctcttaagcgccctgtgagggtcctcccttttaaattatttcctgcccagttatttttcccccaattaatccagaatagttttctcatctgctccagatgcacgcaaactgcagagctgaaatgaactgaactaagagcggaattgaaatacaccaggggtttccctgcaggaattgttccaacgaggtatccacgggtttcaagatccgttgaaatgcttcaggtgtggtttgcattctcaccgaccctcgggccagttccctcgcccccaaccgccgttatttgttccccccacctacttcaatagttgcgcctcacccttccttggcgccattaaatcagcaccccgcacccccgccagttttgcaacttcttttccttgccctttaaaagagttacactttctaagaagacttaaaaaaaaaaaaaaaaggacaagaaatggatataggttttgtaagtgttaaataactttctcagcgtgtattaaaggaagattgtattttatcaactgctgattgatgcagccgtgtgatcctgtcggtttgtctatggtatcatatttatttaacctgctgggggactgtgttcaggggcagcctgttcacgctgacaagagcatgcacattacacactaccccaggtattttgattgattgttcccaccccaaagcctttggttcataatttagcacagcgggttctgcatcacagactaggttaaaaaaaaaatcctgtaagagatttcaatgaacaactactgccaagaaacctttctccacctgcaacccccaaatattttaaatgcccctggagatagctcagtctgtataattaataattacagggcacacaacctttatttaccctagtttccagaagtgtgatcagatgattcattctaaatctatggctggagcaacatttccttaactgggagaggggggtggtggggacaatatcaaatagggtgggcttctcttttcttctctttcactctctttcaatagcaggcttggggtgtggaagcagtagaaaggctgacaaaatgattcttttttacagactctctcctgaggttgccttgggatttagttcataaattcctttggcagcaaactgggtttatactacccctacacactcccaaccccatggtgaggaaagtttttttttttccaggtgacaagctgttcagtgtgtaaaataaactttcataatatttgtgtcttttcaaataaataatcccaatggtctgggcatatcctagc

SEQ ID NO: 1533 - DNA, 1764 bp, Homo sapiens
acgtaaaataaacttgcgggacaaaataccacacgggcgtcaaatgagtctcactactcaatgtggggtccagggaccagcagcatcaaggggacctgggggctggctagaagtgaagaatcacaggctcacacagacctgctaaatgagaatcttcattttaacaagaagcccaggagactgatgagcaggtatatcaggtgcttcctctgggaacaagtagacagctggagccagaagtgcaggagatttataaaggggagagggaacaggagcaggaagggggccttcagctcaggatgcagatctgagatgcaggaaagagaagggaaggaaggagaactggaaaggaaaagcctcacattggggtacagctctgagaaagtcaccaccggcccagggaaggttcaaacaaatttgagtatgctgaaatgattttagtgaggggacctgcccatcttcaccactgcagccctttcttcctttagtcctgattccatcaactgtcccttctattcttttgctttttaagcctcaaagcctatttatataaatacttgtttttttaattcaaataaccccatttttattaattgaatttgagtaatcctttctcagaagatcacccttgtcattgaacacttagaccacttttctaccaaaccaacattttaatgaagctgtctttcggctgaaacgtccaggatcatttcaaagtgcttcctgcaatgactgagagacaccagcatcctgtcaatgctgtatgttcccaagttagttaagaaaaactttgccggcattcggtacccacaaaaaggataagaaagatgtttttttcacacttcaggcatcagatgctcggttttaaaataccctgcctggtgtgaacttagctttcaacatcaaatgcagcttttccaagtttgaaaccaagtggctgagaaatagagatgctgggtgggaaaatgcacatgtgcacggaatcatgttgtgaaactggcatacgtgtgggcaagtgcaaccgttcacatccaaataaacagctggacagccttgcgtgattctgagcccctaccaccagtgggtgtgcatgcacagaagcacacacacacacgtgcacacaggcgcacacacacacgcacatgcatacacacagacattacatcagttactagacatgccaactgaagcactgtgtgtcttttgcattcatgtgtggttccatccatatgtgttttagacatgtgcaccaagcaaagaatgctgtggaaacacgcgatgaaacaaagttgctcttcttcctcctttaaaaagaaatggcccagtacaccttccaaatcactacgattttgtaacatttaaacaaccaagaatggtttcaatcaaaagtattagctgaccttctgcaagatctgtgccttgttggcagcctggagcaggactagtcccggcccgcatactcactccacctttccaagtttagcctttgtgatgaggcccgtccttgtggctgttctgattttgccgcgtgctaaaactcaaagaaggcaggtgggcaatgcagcagaaggaaagccggtttcctgttttaaaatccgacactagttctggctctgccgctggctccttctgtgtcctgagtgagcctcaacatcttcatctggaaaatgggtcctgccactgaagcacagtcattgtctggggtaaatagccgagattcattgtctcatggtcgtggaaaactaagacacggacacaccagag

SEQ ID NO: 1534 - DNA, 1244 bp, Homo sapiens
cttgcccctggagccaatgaggagagacacatcccaagaaggccccaggctggggcagccccctcaatcgggacaccacagctcctaggacctctactgcagaccttggggtctctggcttggggcaaggaggccctggaatcagaggcctggtttggaatcctgcctccacttccccacctgtgtactggggacaccacagtccctccctagtaggggtgcagtgagggctcagtgcgtttgttctcattgccgccctgtgtttattactatcgccattacggcctcatcctccaaggagactgctgctggaaaggccgtggttgctgcgtgtgtcccgcagccccctgcagccagcgtctcctcggccccggcccgaccctgccgtccctgctctgctccctcagcgaccgcagacccctcacgcacatgcccagccctgcagtcctactctgccaccccaaggggcttgggcttcagtgggggcagcgtgcggggcgtggagagggagacgtgtaaagccctgagaggctctgcagccacagtcccgcagtcagcgttccctctcggccaagcctcctggctgcacatcgtttcccgggcatctcagtgagaccggcctcggctcacagcggcacgttgtttttacacttcggggactctggtgggaccgcgggaagccaggaggcgggcgcgccccgggagccgataggaaagtgcaacagcgccatctagtggccgcgcggggaggctgcggagcgcgcgccgcgacccgggatccaccgtccgcaggaaaacgtgttccctccgatgcgtggtcacagcgcggcagcgcggccttgggagcttcttaaacaacaggttagctatcgctgccgcctcagtaagagaagtcaaggccaaaacgcttaaaggattttgacctattcggcttggtggagagcgctaaaaggggacgctatagcgggattctcagctctcctgggctagtgggacccccggtgcgccgccgccgatggggtcttagggcctgtctgtctgggctagagccggcccgggagcctgtttgcggggagtgcgggtcagcaaagctgtcacagaaaatcctcctccaaaggaaggaaaaaactgtgttctcagggaaggtaccctacagagcgcaggtccccacccctgagcgtgcatcggcgtcccccggagcgcttgttgaaacaaggattcccgggcctccctgaggctgtgat

SEQ ID NO: 1535 - DNA, 2831 bp, Homo sapiens
tgggtgattatgatatctcacagctaataagagatagagataagagtctgaccctgatcctctaacttcaaattctgctatctctatcatgtcctgagtgctgccattccccccaccctagccagtggtgggagacatcactaattgatgccagcacactcctcagggaaccctaattcagtcctcaggagctgtgattcatctatggcagctggcacaggagatcaagtcatcccagttgagcattctagtctggaccatgcagtacttcctcctcttatgaccagccgaatgcatttctgagactataatcagagcggagatagaatctttgactctagactgtcaccttacttgtcacatgttaaaatctgctaagctactagctctggactttttatgttggggctactccaaaataagactgcaggtaataatttttattgctgcattagaatagtcagaatttcttattcataagtgccaacaatatcctttgctttaaaatgacttttcttattacagaatataaagaattgaatatgtgattttggcaaccccaaattagccactgtccttgatttggcatgaaaggcccaatcttaaggtctgacttaaatgttttccaaataacgggcactatgaaattcaacttcatgtgtatatagacaatagcagccacagggatagagtcaaattattgcttgtgtagtgtttggagaaaggaaaaaagaggaaatacccacaccctccgaaaaaataccaaatgcaaattgagccatgtttactttgcttttcccctactatctctacgatctgttatttggagagaacaatcactgtgtaatgccagaaaagctttaactcatatgatgcaaagacatatagtattttagattaaaaccaaaacaagaaagattttatattttgtttcttcctattcaatattataaattcaagaaaatgttaatagatatgtgtctaacaaaattattttcaaatcaataattacatgttctgaaaacactgtaagttgtttttttgccatggagacagaaagcaaagttttccaagagcaaaatacacacaatatcaagaaagtgagtcaggctgggcatgctggctcatgcctataatctcagcaccttgggaggccgaggcaggaggatcacttgagctcaggagtttgagactagcctgggcaacatagtgagaccctgtctgtactaaaaaataaaaaaaattagccaggggtggtggcatacacctgtagtcccagctacgcaggacgctgaggtgggaagatcacttgatcctgggagatcaagactgcagtgagccgtgatcgtgtactgcactccagcttgagtgacaaagcaagactctgtctcaaaaaataaaaaaagaaagtgggtcctgaaagcttaaagggatctgaatttatcacaaaattttcatgacttaaacatttttctacatgaaatgctaacataagcaaacatttattattcattattcacttcagaaactcaatccctaatgtaatttatttgatgttcatgaagcttttataaaccatatgctagagggaagggggtttgacgggggaacacccaggatgtctaaaatgtgcaaaattagcatctcatttattcagtaaaattcaatttaattccatttaatttaattcagtcctattcaacttatgttcatttttaaatgctttctacatgccagatattgtgctaacattagaaattcccctaaaaatttaggcaggaattttagttttaaaggagctcacatgtgaactacaaaaatgtaggatagtttgtattttatgcagatttacagacactgcccctcactaggtttttgcacccagctaactgacttcctatctacccttactcttgtcatcatttcccaagatttcagtatgcatgagattggcctgtactcaatcaggcaggaaagagatggcacatgtaaacaggttaatggaggaaaagaggtcaataaaatgatccctggcatggaggaaacccaagatgagcacgctggctcccaagacaaggtgctgggggcatttgctataaccagaaagaagaattgtagggaaatgagcggtgggtttcagtagagacacggcctacctgcagggaccttgaggggaggggctggaggaatggatgctctgtctccatgtcttccctggtccaggctgtgtatctctcagtctgagggaaagggcactgagatggtaattaaaggtcagcctctggggcacagagcagggctgagaaggatgcacagtgtagctgaaggaccacacggaaatgtccagccaacgacctagccaacaccttggcctctcaggtttctgacaaacttactttcctccttactctcaggtgcccagtccctgggtcacactccagacctcatcatcgcccactctgtgttaccactggatcctccaactcacagacccattttggctcttggggggccctagatctattgcctccatgcacatctactccaccgccccctgacattctcactagtcatccaaccctcctgctgtccttcccttcttgtccagcttaatgggcaccgcccattgcctgtgttgaaaatgccctccactgatgcattaattgagatggtaaaaaatggggaaccacctaaatatctatcagcaggggaatgaacatattgtggtttattctacaagttcttgattgaactccatctacatatgttaacatggttgtatttcaaaaacataccactgagtgaacgaagcaacttgtaaaaggatgcaa

SEQ ID NO: 1536 - DNA, 2753 bp, Homo sapiens
agactctctcaaaaacaaaaacaaaacattagtatgccaatggcttcttgtaaaaaaaattttcaggttacttccaagtaactcaaaagactcatcctcttgtttattaatttatccagttggttagcaaacacacttcgaacatctactgccagccgggtgctgtggtaggtgagggctccatgggcttcaatcaggccactttcaagctcagatttacatagcttggttctttcaggaattcttggtcttctgggccggagtgattctatgagagtgccacatgtctgagtgattgttgtgccttgaggtaaagacctgtttgttagagggcctgcaaaactgacttggtcttacagtttccttttgtctttcaaaacaactaatactcccttctcccactcactagtagtttatttttaaaataagctcttttatataattcttatctggtttcctcacttatgaaatgtttcatatttccttacccttgctttttgtggctattgcttctttgaagccaagtaatatcagtcacaccaacattatttgcatactcattttggggattttgtttttccttttggcagaagcctattcgttggcaccctcttaaggtgacttatgaaatttcccacaagtgaaatagtcttcaaaaatttaagtaaattgttcttagctgtttcttcctccttacaacattcaaaaattatttgttgaccatctgtcatgggctgtgctctgcagtaggtactgaaaattctgctttgaccccaccacctaattcttttctcatacatatctcattcctaatgtctagggcaatgacacaatcaagaaagaagtctgcttgacatttctgtttctgtttctgcacacagaatcttcccatgagagacagtcactactaacataaatgcaacaagcagatacaatatgttattagatgattcttgagtaagttaatatgtacacaagctcaggattttaactttgtcttataaatactattttttcttttggcttgacttcctgtacgagtcaaatatatgctttgtgtttttaatcaggaaacatatttgcagaaaaaatcgcacatttcttatgatttttgtgggctccaatatgtgccaacagcattgtgattcgttcttttaaggaatagtggtatttctgtattttaaaaccaagctgaaatgctctttcttctgccttgcctgtaaatatgctcaaagattctaaagcaacaaatgtcatgtctgatgttctttgtagaatttatcagcatctttttcttaactgtagagcttattgcttagctcaaagtgtttccccagacctctgatgtctctggtgccacagttctggattttaaaggacttaaccaacatgaatccattcttaaggcagcagattggttggtgtacttgtaataactcagattattaatacaacaagcagatacaatatgttattagatgagtctcccaaaagcaaataagtacacagccttgggatttatttgttgcacaaatatgaaacctccaggttactccacccccgtgagcttcataagtagttaatgatgatccaaaggacattatcctttaatgagtgtaaatcccgtatcttcatggaattgaatgcttttgcttgggagctgttttagtccgttcttatgctgctgtgcagaaatacccaagactgggtaattcataaaggaaagaggtttaattgactcacagttccacatggctgaggaggcctcaggaaacttaacaatcatggctcgaggggaagcaaacatgtccttcacatggcagcaggagagagaactgctgagcaaagagggaaacgacccttataaaaccatcagatctcatgagaactcactcactatcacgcaaacaggagcatgggggtaaccacccccccatgatttaatcacctcccaccgggtccttcccacgacacatggggattatgggaattacaattcaagatgatatttgggtggggacgcagctaaaccatatgaggagctttatttttaaaaactaaatggctgtggtatgaaatgtatcccttgtatgaatgatttgcatttaacataattatcttttgctccttgtgttaagtttcatcagcgaatcccccaaaatgcactttttatgtctgtggttcttttcaattgtgatttattcaaatgtatacatcctggtgtagcataaaaattattggaactagggttctaaccaacttcattttttaaaaaaaattatttttaaaatttttttcatttctaatttttgtgggtacatagtagatatatatatttatggggtacttgagatgtttgatacaggcatgcaatgcataataatcacatcatgaaaatcacattccctcaagcatttattctttgtattactaacaatgcaattatacaattttagttactttaaaatgcacaattactgactgtagtcaccctgttgtgctatcaaatactaggtcttattcattctttctgattactttttgtacccattaaccgttacccagccaactttaattttttaaaattagaggtaatgcaaaagtatctaataactcaaaatttacagaatttcctgagttaagaaaaaaattcaaaagtgatgcttgccttttcgctttcctaaagatgtcatttgaaaacaagtcttctgttttgataaagttaaattaatccatttcaattttatagtaat

SEQ ID NO: 1537 - DNA, 4777 bp, Homo sapiens
aggcggagcttgcagtgagccgagatcgcaccactgcgctccagcctgggggacagagcgagactcggtctcaagaaaaaaagaaaaagaaaaaaagaaaacggggtggacaaatcgatggggaggcggctcaacctttttccttctcaggcagaagcccctgagtaaggccgccgctgccacccactgcccctgaaaggacatctgagcacagtgattccggtggtgccaggactccaaccagcaaggagcgtttcgcacagagctgcagagagtctgtgccttccaacgagagccgtgtcccgaacgccatccacttagctctcactctcctccttcctcctttccctgccgctttctgtttttcatcagggccttggaactcgctagtacagaccgactttcaagttaagtctttcaaggaaaatgactcttggtttccagcctggatgtgtcattacaccctcatgcgtctcagggaaattagcaacctgattcttgccctgactgtcatttaaaataaaaagctttcttatttgccatctaagacaaactctagtaaacccacagcggacgggtaggaggaatgaaacacagttactcgtattcagcaagttcctggggtcatatttacccgcatgtgtctccgggtaactggggggtggcgcgtgtttgccgttgtgatgcgggcgtgtgtgtgtggagtctgtgtgcgctggagagagcagtgtgtccccccgaggacctcggggtcccagagctgtgcacacgctgcccccctggacgtacagaaccagcaggtggcatcgctccacacaggccaccgaacggccctgccccgccccctgccacgccctgtgcgtgcatccgggtccccgcgcagtggctgcacgcagcccacctctcccgacgatccgggtcctcccgcccttcgcggtgattctgtcgcgaaccctctcacggcagctatgagactgctgcgctccccagacgaggaaacctggtctcccggagccaggtaacccacccgcagcctgcgggagagccgaggtctgcagccgggccgtcgggctgcctcttcccggggacccgggagcggggggcggggggcatggtggcctctcgggctgctccgaacgtcccctccaaacagcgaggggacgcacagccccactcaggagggagccaatgacattgaacctgaacccaagccagccttagactgaactttcaaagtaccattaagcaacgccgtgaggaaatggaacattcgacaaggtattatgtcgcatctctctctctttttttttttttttaggtggagtctcgctctgtcgcccaggctggagtgcggtggcgcgatctcggctcactgcaagctccgcctcccgggttcacgccattctcctgcctcagcctcccgagtagctgggactacaggtgcccgccaccgcgcccggctaattttttgtatttttagtagagacggggtttcaccaagttagccaggatggtgtcgatctcctgacctcgtgatccgcccgcctcggcctcctacagtgctgggattacaagcgtgagccactgcgcctggtcgcacctcttttcaaaagccagtgttatctgggaaagtgcaaggggtggggagtgggaggtgctgttttcaatgaaaagaaatgaaagagacattgtgcgtcttcttaggtgatattacagtaccacagacactacagttaggtgactgagtccagtattgtctgttttctcaggtgtgatgactgtgtcgtgtcatgcagaaaaatgtccttatttctaggaatcgcatgctgagatctcggggagtaaagggccaggatgtctggaacttaatttaaaatgatttgacaaggacaggcatacacatagggacaaagcaaatatggtagatgttatcaattgctgaatctatgtgctgagtacacacgtatttgttgtattgtcttttcacctttcctatatgtttaaaatctttcataatgtcattcggggggaaaaaaagctgatctggctatacttatttgggaatgtgccggctaaaagggaactaacaaataaaaacttaacttagaacataaaattttagagactgaaggaaccggagaccttctagagctcaactctcattttaaagatgaggaaagtgggcatattgattttatcttattttctttttctctttactttttaaatgtttttggtttaactttaagttcagcggtccatgtgcaggtttgttacacaggtaaacttgtgtcatgggagtttgttatacacattagttcgtcacccagatattaagcctagtacccaatagttgtttttcctgatcctctccctcatcccaccttcaccctccaatagaccccagtgtgtattgttcccttttgtgcccgtaagttctcatcggtcagctcccacttataagtgagaacatgtggtatttggttttctgttcctgtgttagtttgctgaggacaatggcctccagctctatattgaatagttaaaaactatttaggccgggtgcagtggctcacacctgtaatcccagcactttggaaggccgaggcaggtggatcactgaggtcaggagtttgagaccagcctggccaacatggcgaaaccccatctctaataaaaatacgaaacaattagccgggcatggtggcagatacctgtaatcccagctactccggaggctgaggcaggagaatcacttgaacccggaagacggaggttgcagtgagctgagatcacaccactgcattccagcctggtgaccgagcgagactccgtcgcaaaaaaacaaaacaaaacaaacaaaaaaaaaactctttaaaataagtgttataaactaacagtttatttatcccaggcacagaaagacaaatactgcatgatctcacccacaggtggaatcttaaaacattgaactcacagaaacagagtagaatggaggttaccaggggctagagtgtggggggttggggtgatgttggtcagagggtacaaaagttcagttagacaggagaaagtttatcttttagtgattttcatgattttgacaaagttgaaacaactgaaacaaagtatctaaatattttaatacttgtaattattttttaattgttgagtgattttaatgagtcaaaaatataaaacaatcatgcataatacatataaataatttgagtgtccaacccatattacagatgaaagtaaagaacaggcagattctgagacttgggacaggcagcatttggcacctgcggaggcccggttctacacgtctgtagtggcagaaaggcaatatatattaaaacctaggaaaacagtcagggcacggtggctcacacctgtaatcccagcactttgggaggccaaggcgggcagatcaccaaaggtcagaagttccagaccagcctggccaacatggcgaaaccctgcctctactaaaagtacaaaaattagccaggtgtggtggctgtaatcccagctactcggtaggctaagacaggagaatcgcttgaacccggcaggcagaagttgcagtgagccgagatcacgccattgcacttcagcctgggtgacagagggggactccaccaaaaaaaaaccaaaaaacaaaaacaaacaaaccttggaaaatgggtgagagaggatggtatgtgatggttttatcaagtacttctactctatttatatcaactactccaagctgtggtaaacacctctgggaagccaggtccagtgcaagtgggccaaagcccgtattgacagttataaaccaggcatctccagatgacagctttatgacccaagcagtgtgctcctcactagactagtgcagtacgtatcagagtccagcagggagtgtgcccacctggaggaccagggtaaaggtgggaggccaggagcagggatctgggagctaacaataactcaaagtacccacgttcatggtttccaccctccccctgagcccccacgtatgccatccccaaccctctcccccatctttcaagtccatgactgccagtcaccaattagacccatcactcaacagccctggttccccaacagatggactcacaagaacaagaaacaatgactcggtcattagaactcttagtttcccacaattcctgtcattgggattaaagttctccgatgttgtccccatcatgtgtctgagaaactggccatgggcacctcctgaaaggggaagcaagagtgactctgggggcttgttgtgctcctcggaagaggttctcactcctttagcatgtcgctgcctggccctggacagcaaaaaccaaccctttgagaggacttaagtaaatacatcatcagatctgggagctgatcaaaaccttatttcgttgcactcacatgtatgtgtttcttaatgtacttgatcttggataaaatatatcctagtgcattagattttaagccatggatacacatcctaagttgaatatccagttatattaatttcattcatgttaattgatataaatattaatttatggtgaattatagatttatttaactgatgtagtagtgatatatacataagaattcctggaaggagatgaattcatataagctgtgtagagaaacctatattctttcaagtcatcacagatactttataaaagtaggtacttcgggtaccaaatactgtagtgtccccagcaaatctgcagcaattggcttttgacactgaaatgtt

SEQ ID NO: 1538 - DNA, 3015 bp, Homo sapiens
ccatggaaaaattgtcttccacaaaaccggtccgtggtgccaaaaaggttggggactgttattatgtaatatatgacaaaggcagaacttcaacttagtgtaaaaggatgcttgcgtgcgttaataaacggtgttgatattcctgcctggaagggggacaaaacacgatactagattacaacaatcaggtttaagtataaaaaaagaaaacaataacatttaaggaatataggtataactttgctatgagggagatctttaaaatctagttggaaaatccaggaataattttttaaaaagactgaaatcattggcttcataaacattcaaaaattgtgttcagtgggaagcatcataaaccaagtcataatgcaaacagactaagaagaaatatttgcaacacaaattgttgcaacacaaattggcttaagtccctgatatacaaagaatgcttacaaattgatttaaaaaaaaaaaaaaaaaagacaacacaataggcaaaaaaaatgggcaagggatataaacaattttcagaaaaggaagtccagagggccaggaaacaaatgaaaaggtccttaaccacacgaatagggaaatgcaattatgaatttcataactgatccttttataaatgaagagccttaggactgtagaaattgagtccagacatagggatttcacttagaaggaaggggaaacaaacaccatcttctccttcatgccaggcgggatgatgggtatgagaacaggagctagtgtagacctcggtcacgcaagccacttgctgtgtggattagaaacgtgtctccagtttagaaatgccgaatccttcctgggaccacggaggagtgtgcaaggaagtgggctcagcactcaatgagacgccagtggggaaaatcacaggcatgcatggaaaagcaccataggactacgcgcggtaccaatgctctagaaagtgacagctggcagcccgcagaagtacatctggggagccatgtgagggggccgcgcccctgggaggttctctggcagaggtgaatcttggccttggcagatgacaaaggcctcttgattctttaaacttcatctagaaagttgaggcccacacctgagtgaaaagaaggcggctctttgcaaacccttttcctcagtagggttattctcccagggccatggacccttgggtaaggaattatctacaaaagacagcttgtttgcagtaggatagtaaaattccaagtagatttatgtacatccaaatagtcatatttgtgcagtggcctcatccaaaaataatttggatggccgtttttacggtaaaaatcagaccagcagagtcataaataacttatgaataaataattacagttcttaaataccttgaactgtgttctccccagctcagtgcccatcgttttcaacactgggccaggaggtctgttacaggtgttgcctctgtttgcaatcatagctcattattccagccatctcttacttaaagaggcttcataaacaccgtagcgaaactttaaaagtttggaaagcacagaggccaggtgtttagaatgtgttctctggggagaaagtaagcctttctcattatgacgttctttcatgaaaatgtgaattagggcaggctaatattgatcatcttttttcattgaaggaaaaaaaaggaagctttttgaacatttccttacctagcaaggactcatacaaagccatctttagaaggccggtgcacctttatttccgcaggagcccctgcagtgagtcccattcacagtacagctagctgggcagattttccaggcattggttttggtattccattatcggctctccctgaatgttctcagaggccaggttacccattaccattgttattgcagctacatgtgtggaggaaagccagagccgaggcggggtagctatgatcaagggcaaccgagcctggtttcagcccaacaaaagaactccggcttctctattttccatgtctggcagggaaccctatgagagggctttgaggcagttgtttaatcttgaattctccgagctcccaggcatgctgtcctgccccctctccaggccttagtagggaggataaaggcacttcagagattctgctgaaatccaaacctctgattcccatcagtgtgcgtttccaagctctttctcaactcaaatgctctggtgcccgtggaaacagcaaatttgacatgattttcatggtaatctcatagtgagcctaattaataaagtcacttaaatactaaacagttggctggcttttcaaagaatggcattgtaagaagcataaaaacagccaactgtggtatattttcattaactagctttttttcatggaaaaagcaacgcatgtatattttaaaacaccgtttttgaacagtagcaaagggcatgggataaatattcagtcctctagtaattcctttccccagagacaactatggagttcagtgcatctctggtaaccattgtgttcctgtctaacaactgtaacctctgtgcatacacatgtgcaggtgtggtgtgtgtgcatataacatatacatggtatgcgtgtgtgtgcatgcatgtgtgcacacattttctgctacactaataagccttctagatatccggttctgaactttttttttttttttttttttttgagatggagtcttgctctgtcacccaggctggagtgcagtggcacaaactcaactcactgcaacctccacctcccaggttcaagtaattctcctgcctcagcccccccgagtagctgggattacaggtgcccaccatcacgcctggctaatttttgtatctttagtagagacagggttttaccatcttagccagcctggtcttgaactcctgaccttgtgatccccctacctcggcctcccaaagtgctaggattacaggcgtgagccaccagcctggcgcaccttgccttttcaattgatgggtagctcttgagtattacttcatacccccata

SEQ ID NO: 1539 - DNA, 5457 bp, Homo sapiens
caagatgtctctgtatgtgacaagtctgttgacagcaggctcctcctctcctccctcccacttttgttttaggtgcctggtctaacatatgaggtcattcaccattatctcggaaatgctcgtagctggtctgaagttgctggagaggtggtgggtggagcacacttttgactccttcagcattagattctccctagcttgcttatctcagttcacagttttggagatggatactcaggctttggttagggggagcattgctccagcaggatgcctatgtagtagtattcatgatacattacagaatttaaatgaaaataatccttgcccaatcagtccacccattggtactgtctgagcacccacataatggcacttggatagcaccccaacaaagatctcaattcaaaccaagttgaatagacccaaaatgtaatctcatggagctgaaaattccagagggttggcctttacccctaagtgtgacggaatctggatgctctaatgatgcctcgaggcatctgtcctactctgtcctttccttctgtttttgttttatttgcttggtgggggagtggccaccctcagctccaaactctgtttgactatctcagcctacccagcagcaggagggagccaagtttctgcaaaagcctcaaggcttgggctctttgggttcacctgggtcagaaacccacccgtagagcagtcctgccaaagagaatgagaacaagttggcttttttttttttttttttggagacagagtctcgttctgttaggctggagtgcagtggcactatcttggctcactgcaacctccaactccctggttcaagcaattctcctgcctcagcctgccaagtagccgggattgcaggcatgcaccaccatggctagctaatttttgcatttttattagagacggggtttcaccatgttggccaggatggtcttgttctcctgacctcatgatctgcctgccttggccacccaaagtggtgagattacaggcgtgagccaccacgccgggcccaagatggctttttgagatgaaaacacaaggaaagagcatgatgaaagagatggttcctgagtagaaaataagagtcatagaagtggaagaatttaaacaattgccatagggcccagcaattcttttgtcaggtatatgtatatgtccacaaaagatttgtacatgaatgttcatagcaacattgttcacaatatccaaaaggtagaaactaatcaaaagcccatcgagggaagactagataaacacattgtggtctatccatacagcagagtattttttatccataaaaagatatagagcactgacatgagctaaaatgtagatgaaccttgaaaacatgctaagtgagggaagccagacacaaaaggtcacagaccttaggattccatttacctgaagtgtctagagcagccaaattcatagcgacagcagattagtggttactgggggctgggggctgggggaggggttttgaggagtggctgcttaacgggtctgaggtttccttgtaatgaaaatgttctggactcagatagcgatgatggttgcttaatactgtgagtgtattaaatgtttctcataatacatttaatcttatatgcatttcaccacagtcaaaataaatattaacccattttcaattaaacaactagatggagcaaatcaggattgctgagtgggcaaaattattctgtagcccatgtccataggtgccatcaagatcaaaaccaacaccaatgtaagttgtgaatgtaggctgagctatggaagatatgggaacatatgcctttgtctcttaagccacaagccctgattttcatttccaagtttctgcactgtgatactgcctgaggtcctgggtttctgtaaaagagacaactgtcactctgtacagtactaatcctacactcatacacatttcttgcctttttactcatgtgcggtttaaactgctaggcacctcacagggttatccttcttactagttcaactgttagagtttattgagtctctcatatgtgcctgcaggttttcttagacctgtcaacaaacttggaagtgtatcaaccataaacccaataactaagtttaataagtactgactgtctcctagcatctctgttcaatacattatttttttcattgcattgtctcactccagccctgaaaggtaggtgctattataagctccactttgcagatgaagatattgaggctcagagagcacaaggaaatggcccagctggcaggtggcagggacagaattcagactcagagcccccctcactgaaatccctggtgaagccatccagcagagtaaatgaggacatcagcaaatgctgggtgctctcagcctcacacaaaccagagaaacatccattagaaagcacaaattagaccatcttgctctcttctgtggattccctatttatagagtgcccagtggatgctatttctaacttaagctaggaggttttctttgaaagtttcaatctgcaacttaaaagcaaagcaagagaataaaagagctgggagtgcacttcactaaatgcggttctgaaatctaagagcaaggaggcagggggagagacatgatcatcttattagtgtagaaggataaagatgatcagagagggatgctccattatttataggaatccggttcttttctatacacttcactgaggcatttgatatatttgtgctggagattaacactgatgttattttctttaatgtctgtttttagtgtatgcggtgcatgttggcattcaggaaattcagccagaggagaaaaacaatagtattaattaggaatgtcagtcatgggtgttatgaaattcaaaactgccaagtttctggagcatttagtggtaattataatagactgtagagacaagctgttcttcgtttcctatacagaaatgcacagtttgatgggcaagtgatcaaagtgctaatgcaaacccttctgaaaggggtgcctctctcaccctgttattttaggagctaatgcttttgctaattcagagctgcccagagagaggagactatccagtgaatataaggccccttgtctttttataatttaaaatgactattcaaattatatctccatccaagttgcagtgtgagctgggggttgaaggatgccacctatcagccttgcagaatatttagatttaaatcagagccatagctttttccaggtagagtcacacttataatcagttttctctcaaagtgatgaagaataaaagcctgtcctatgttcttcaggtaacccagttaaatgggtggagagatttgcatctttgagaattggaaaaaaaggggtgcaactttcttggacttgcctgggttgctggttagaggtttatgtctcttggtatgttttagagtcattctctcagtctgggggcaggcagtggatcaggtagaatggcagggatggaaggattccatcctcagtaccctaatgtattatattctcttaggtgagcttcatagtggccctttggaactgtctgggcagatgcctacctctctgatgagtaaaatgaattacagatcaataaacctgccccaggttattctgatgccatgtgtcaggagggctcttgacttcatgcctggtgctgtctctagtgcttcccaccatttctgcacctcttcagtgccctcctgctccagggcctttgcacatcctagtcttcatttctgctatgctgaacctttgaaggctggctttgggtgcacctcattctttaaggacaagcacacccctccagaccctagcaaggacccaactgtggaaacagtaagtgcgccacgttctctgtaagattttcatttgaagaaaacaaaacaacccacaaagagttaagtcgtattttccaggaaaaggcagagcagtgggagatgaagactcatccatctctgattttttttcttttataaccaccacctccattagctggagataatgatgtcaagaggaaaaaaactttagcggttgttggtttgcctgtaatttgtgtggctcacaagcagcccagctaaattcagtggtttctgatggtcctacctagaccagagaaataagagagggatgatcagaaatccttcaccgtaggtgtgtgtgtgtgtgtgtgtgtgtgtgtgtgtgtgtctgggttttcatttttaataattaatagtagttcattctccatcctgaacttttgcagaaataattagggagcttggggttgggtcagtaattgctcagaaacgtgcttggctgcagagaagcctccactctggggtgggtgagatggtggaagcgcctccacccgcttccagcggtttggaagtatgtctagcggcatctctgcatcctttggaaaagcagggcacgcattttcctgctgacacacacaagccttataatttagcattagaaaagaaaaatggttttgaacaagaaaatatatttagagctcattattcaagtagaagtcacagagaaggggcaaggacggagccagtcaacaagaagcaacccacattacagggtcagaaggaagcctgtgcctggcacccaggagccaggcaggaagcaggttccaaggtcgacagggttgatatcaaggtcacacctcagtaaagaaggtgcatgaagctatcttctctcagagggaacccatcctgaaggctctgtccagaactacttctgtggatttccttcctctctctggctttcagcacaggtcatctcacagtccatttccatgttcaagcctcagcagggtctcgcttggcacctaaaggttgacgtcagtgtcactgaggccagacctggttgttccgtcaagtggaaggggctccatggagggcaactatctccattcagtgaagttcatgtctatctttgggggaagcccacattgcagttcttttccatctttgacttgcatttcttctctccttctctagctacttattgtggcatccctcctgtctgtatccacaccttttctcttctaccttacaaatacgtatacacatggcagtgcatcactgtaattcttggcctcattgtaggccttgtggctctttccgatgttgtctaagactcattagcatttcccagcttagcattttgcctgcatcatctgcttcagccttcagcttttctcttctgcatcaaggctggttacaaaaccgaaagggggaatgaggaagccccatgggtcttgatgcatccaggggagaggaaagataacaagtgcttctgtgtgtgacagggactatgccagttgctttataaataccatgttgccattgaatcattcattcttggttgtccatcctctatgtagtattgttctaggaggtgattctacagcaaaagacacagcagatataagccctgtcttc

SEQ ID NO: 1540 - DNA, 2839 bp, Homo sapiens
gaggtggcccctgaacatttcgcaaacctttcatgatctcactccagttttatgactttcctttctcccacacggagatgctgagtgctgtattcatctttctgcctcgctatttttccttcatttccttcattgtctgcttttctggagcattgtaccaaatggcttggttgttctttgctgaacatgaaggactgactatcaggaattttcttttgtcttctggaattcactggctttttaaaaagtcagatatccccttcgactagatggattttatgttttgtttaatttttttcttcttgtgggtaggaatgtgtcatactgagaggcacgtagtatatctatcttggtattgacagcgttgaaccatatgtacacttttgaggtatctttgctcttaagcttgttgattttcctcttctgaggatgcatacgaaccaggtcatctgttgcaattaaaaagaaagaacatttttaaaacaagaaggtctaatctctttcttgtgcaaacaggagactgaggcccagagagagttaaataacctaatcaagaccaaatggctggtaattagcagacatgagactaaacttatgccccttttagtgattcatttagaaaaatatatttttaagacatttttcagaatactaagggagggtttttaggtataaagaatgtagtgaatgcatctttgaaaagtagcataaatgacttgaaaaaatgatattatcagtgaaggcacttcacatattttatgtgggggtgtctctcatacttggggcagaccccactgccattgattctgttgggatatgatgcttgaggttcttattcttaaagataactgcaccaagtttgccttgatcgttttactatttccttgagattactttcttgagatgatgagaccagcttgaattttcattgtagttgtgagacctttctcaggttgaaatgaattctgataagctgattatctctctgaagaaaatatgatgtccacatttcatagcttagttccgatcacttcagtgccattttcgttctgagacatcttcccgggtctgaattaaataagataataaggtgctctggagtccagtacgtattaaatagatttttttttttttaaaaaatcgaggcctacagagtggaggatggctttctttatggtgtattttctttctccatgttgaagtaggtagcagctagctagtttctttttctttatagagcaatgagttatgaagctcaaaaataaagtgttctcagtggtgtaaataaagcagtagtctgagtaaatatatcacactatgtactgagggtttgctttttgcgttattttgtctctttcttttccttctccgctctggtccagtttatgccattgtgtattgttgacacattaatcttggtaatagaaatggaaagctacttttcattgagaaatagattcaaaggaaaagatgattaatgggctgggcacagtggctcatgcctgtaatcccagcactttgggaggccgaggagggtggatcatgaggtcacgagtttgagaccggtctggctaacatggtgaaaccctgtcttttttttttttttttttttttttgagatggagtctcactgtgtcaccaatgctggagtgcaatggcgctatctcagctcactgcaacctccccctcctgggttcaagtgattctcttgcctcagcctcctgagtggctgggattacaggcacgcactaccatgcctggctaatttttgtatttttagtagaatcggggtttcaccatgttgatcaggctcgtcttgaactcctgacctcatgatctgcctgcctgggcctcccaaagtgctgggattacaggtgtgagccactgcgcccagcccaaaccccatcttcactaaaatacaaaaattacccaggcgtggtggcaggtgcctgtagtcccggctattcaggaggctgaggaaggaggatcacttgaacccaagaggcggagattgcagtgagccgagatcatgccattgcacttcagcctgggaaatacagtgagagtccatctcaaaaaaaagaaagataattaatgaacagaagttccatgcattcccaatgatgtgtttttttatcctggctctataaatctgtctgcattgcagcctcttgtgagctcccagattactgtatccctcctccgtctcacctccatggaactggtggatttagctccaaagctacctggtattgctaacggaggaggaggacacttagaatcttgaggactatcttccctacagagccgtatgcctgaggaggggagacgaatggctgggaatgatctactcagaggggagacgttacttagaattgctgtgttggtgaccagcatggtggtgcttgcctgtaatcccagcactttgggaggtggcagcaagcggatcacttgatgccaggagttcaagaccagcctggccaacatggtgaaaccctgtctctctaccaaaaatacaaaaactagccaggtgcggtggtgcacgcctgtggtgccagctactcaggaggctgaggccggagaagggaggtggaaattgcagtgagcccacatcatgccactgactatactccagactgggtgacacagtgagaccctgtctcaaaaaaaaaaaaaaaaaaaaggaattcctatatctgagagacgttgctttgtaaacctgttgcacaatttctctctccaatgacaacaatcaacagaactagtgagatgatggataataaccaaagtgaatctgttgggaaggggtgatgcatggtagaggagcttcctgtgtgtg

SEQ ID NO: 1541 - DNA, 1700 bp, Homo sapiens
tcctccttccaccagttaacaggaagttgactcttcatgggttttgtaactttgaagcctcagcaaagtggaaataacactttattttacacgaaatggttgtaagagtagagggagatcgcatatgtgaaaacatgtgtcacgcagtgggtgcctgctaatacctcttcccttcttttctccatgttaccccgacatgttacaaggtggggaagatagtgaatggtccacagtgtgaacagcaacctgtgggcatcctcaaatttgtttgcatctcatttgtgtgtacacggtatgttcaagcagagaaaatagcagaatttcctgatggttttcaatggtatcagcatgcttttatggttcgactttaggatctgatgttaaacgcaaggatgtacgcaaatgtttattagtttcttatgcatggaactggtgggttgctggtgttagaggctaatgtggccagaagatggcagtgcacgataaagaaaagctcccaggcgccagccactgttttaattagctaaaaggaagacaggtatgcttttatatagtttttgattttgtaattttcctgagcagccattgagggcagatgttttcatcttttcccccagtttaagtatcataggagagggaatatcaagatgcaatcaattgctggccacggcaaacctcctgaacttaagtcttgcaaacatcatcagcttgtgccatcttagaaattgctgcagtggaaacaggcatggagctatcaattacttctagggctgcaatcccctctgtccttgaaaaggaagccagctgattctgtgagtgagatgaggggacagccactggaatgggaggtggcttctttatcagtgtcttagaagttgatctggagccctagaggaagaaattaaagatcaccttaaattgtgcatgagggcctagccccctgtcgtgaatgaccgttaactggtcagcaaagtaattgaaacaggaaagtttggaggaaaagaaaaattccttaaagcatttcttttttctcttctagttgttacctttgtctttagagtgagtaatccttcatgcaaaaggagctagcatgttctctatacatacgaagtcctaggcatactttatacattttctggctttacttagggtgatcttcaattaatctctttggcaggttgtattagtaacattttacaaaatgggaaaatgggggctcaggaatagtgaggaacttgcctaaggctgcaggatgactgaaaatttacaggtgaaattcaaacctccatccctcatcatttccctatttcctgtccagaaaggaatgctaaataaatacgagctgtcaccttttatattccattccttttctttattcctgctgtacttactaaccaaaaataaagacaggaggtgttgttaatcattacactggcaataaatgacttcacgtaagtgtactaagagagggagagtttttcttttttttttttttttttttgagatggagtctcaccctgttgcccaggccggagtgcagtggctggatctcggctcactgcaacctccgcctcccaggttcaagcaattctcttgcctcagccacctgagtagctgagattacaggcatgtgccactatacccagctaatttttttttttttttttctatttttagtagagacaggattttgccgtgtt

SEQ ID NO: 1542 - DNA, 1904 bp, Homo sapiens
gcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcagg

SEQ ID NO: 1543 - DNA, 2237 bp, Homo sapiens
gatatgtatgataaatatgtaacatacactatttacaggtgtaataggtcatggaatatggtcaaaagaacgtggaagtcatgagagcaggtaatagctaaggccccttgcaattttgcaatatggtgtcagtaagatggtggtttttaagcaggggcaattttgcttttcaagggagatttggcaacatctggagacgtttttgatagtcacgactttgtggagaaatcgtgtgctaccggcgtctaatgggtagaggccaggggtgctgctaagtgtcttgcattgcacaggacagtcccccaccacagggaattacccggccccaaatgtcaatagtgtggacgttgagaaaccctgctctaagggtacgtgtggatagaatcacttaccagtagtagccttattactactaactaggatttacggagcacttactatatgcaggcatgcttctaagtgctcacattgatgaactcttttaatacttacaacaggtgggagataaaagtgtgtttccttcccccttttcagatgaggaaactgaggcataggatgatcaagggttgcccaaagttacaaagttagcagaattaggattccagtgcaggaattctggctttaattccttgaatcagcgttttatgcttccatagcacttcagtctccaaagcctttttttttcctgtagcaaaacacatgtaaaatttgccatttcaaccatttaaaaatgtgcgattcaatggcattaagtatattcacaatgtcgtgcaaacccgttcaacaccaccatcaatttcaaaatttttgccaccccaaacggaagccctgaaccagttaagcagtcattccacacattctttcctctcctcggcccctggtaacctcccatcttttctctgtgtctatgaatttgccgattctagatatttcatatgaatgaagttatgtgatctgtggtcttttgtatctggcttctttctcttagcataatgttttcaaggtttctacatgacgtagcctgtgtcataatttcattccgttttatggctgatttatattccattgtatggatagatcacattttgtttatccatgtgtctgttgatggacactttgtttgcttccacattttagctattgtgaataaaactgatgtgagcccaaagctttttttttttatactgaaggtggagaaggattgtatcactgaggacaggggagaaatccagattgttttggtgacagacactgttcttagtcatctcacatatattatctcatttgatcttcacagtaaccccacgaagctcccccatttttacagatgtgaagaacagagagggtgagtctcctgcccagggtcacacagcaaatcagggcacattactctttgtcacgaagaggagaagtgtgtgtatattatgcagcagaactctgagcagtggctgccttctagaacaggagctgaacttctgatttgcacagaaatctagataggcaaaattccctcaatactcatattgcactatttctaggtgctgtatttagacatgtatgaagaagcctcaattgagaataaagatagttctccttgtgcaagaaaaaaaaaactacttttaatctctgagattcagtgccatgactttcactcattcttgatttgttgaggcttccttcacagtcaatttattccctccgtctgcattgatgaagaacttactatgtgcaaggcactgctccagacatgcaatatggcagtgaacaggacagaccaagtccctgtccatgtggagtttatgttctagtgggggagacaggtaataaaccagtgagcaaacacacaagtggtccagacagaggtgagggttaagtattgcaccttcctcttgaaacatatctgttggctctaacgacgtccacaaggagatactgaaccctgaggctggagggtaaactcagcttcccaccctcaactcactctgttcccaggaatgaccaagtgtttatcatgatgaattgagcgtaacatcttcccatcatccttggggtccctattacagacagagacagagctgaaagctagattcattcatatctgactttttccactcacttttttttctctggagtggagtctatttaggaaaacaccttcaggggtcaaggtgatctcctatatcagaaatcagcagactttttcggtaatgagccagacagtacatagtttagtctct

SEQ ID NO: 1544 - DNA, 2640 bp, Homo sapiens
aggaagaggatacatggaaatacatggtgcctcttcaggccttggcttggaactagcacacataatttgtggggtaaaataaacaaatggccaagcctgaagtctattctgcctcagaaggatatgttggacaataatccaatttatcacagtgacataacaggatgattgggtttgttcacgattcaaataataaaacctcgttagtcacatcttctttgggaagtcatttctaagaatggtatcaatctaccttctaggcttatttttgaaactccagcaggtgtagaagtgctctttaaaagccaaagcacctgaaatttactcttcataattgttacaatagcgatgataaaaacaaatttgtctgtgaacctcaacctgagcatcctacttggacattaattttctgcaggatggctccagggatagtctaatgctgccgctgttgatacgcagagtgcagatctcacagctgatgctgactcgagttgtaggatggcagaaagaagatgacgggattggggcacatgctctaaaaatgtacactgaatctctttcagcatttaacatttatctatttctggtttttaacctgccctccattgcaattgagaaactctgtaactctctatttttttcctagaaagcccacttgttagtccaaaatgagcattgcaggccaaatatcttccaatgagctcaaaccctgcagacagctctcaacgttatgactgacaggtgtactctactgttttgcctgtgtcatctgcacagtgggtagggaccaattacctacaaatatacaggagtgagtctggggttggaaatcaggacgcctggcttctagggctggctttgtcacttttccttctggttcctcatctgtaaaaatggagataataataactgccctactttctcacatggtggctgtgaagacaaaaatgagaaaagcatgttgcaaaataagaaacactattcaaatgcaagacagttttagattcttcgattcctctctaaattaatgatagctcgtcacatttgtacaatgcttctcaattttcaaatcacttctacttgtgttatctcatttggtctgccctaccatgctcagtttttcagggtaggacacggaggattgaagaggtcatatggcttgcctagggtcatccagtaagtagcagagttgggagaatagcctgttttcccaatgctaattctgcactttttacattggaatcctctgtttcagcttctctgtcaaagccagccctggaagctcatctggaaagtgtttgtgaggcggaatgtgcacacagggttattgagagtaactgtggagtctgtccagtactgggaaatactgatgggctttgtggtcaagcttctgggtcacctgcggggctctccccaatctcgttccgctggtgtctccttaggatggtaaaaagctgggcaccaggtcagatatccaagagggatttcttgaattctttacagtgatgggacaaaatctcctgggacatagagctatacacttacttaaaatgaaaagcaactcggagatctttctagctcaaactgcacgtgctacagatagaaaataaagggttgcagaagaatagaaactttctcatgagtaaagaatgggttttggggcctggcgtggtggctcacgcctgtaatcccagcactttgggaggccgaggctggcagatcatgaggtcaggagatcaagaccatccaggctgacactgtgaaaccccgtctctactaaaaatacaaaaaattagctggacgtggtggtgggcgcctgtagtcccagttactcgcgccactgcactccagcctgggctacagagcaagactccatcaaaaaaaaaagaatgagttttcacagatctggggatttattctcagctcttccacttactggttgaggagccaggatgattgggaggataccatgagataaatgtatttaaagtattatttaaagtattgagaatatagtgggcactgcagctatagtaaagtctgagttagtgaatgtgcttggctgcagacaactgaactaattcacctgaggttctttgagcagaaaagggatcttttaaataggatatcagatagctccttcatggagccttcaagggtgctgagtcaaacttcgaaacagccaggaacaaagtctctacctggtgagactgctccagtgaaaaacctaatgctgtcactgctcagtgcagatgctaacagcctctcccatctccaatgcatccctaaatattctcatcagaaaatgacttccatgtggtatctgctccccaggttgctgtcattcaaactgaaatctcaggagagcctgtatgattggcagagcctaggtcacatgtctgtgccatagttgcaacggaggctgggaaagttagttctgggcttctggattgggaaggaaatgtttataatgcggaaaattccctgaacttaggaaggattttcaaaagatggtagagtgtttaagacataatcactgaagtttcctgtgtttgtttcttttattccttgaccctttatgtgcacagagattgtagcagactcaggctccagaattccaaaccatttccttttattaca

SEQ ID NO: 1545 - DNA, 2653 bp, Homo sapiens
gcagaccagggcaagacaagagcacggattgcccaccccaagcaaaaggcagaccagccagcaggaagctgtgatcaggggatggagtgctctcattgaccagcctggatttcatgcccatcacggggctacacatccccaaggccaagttcaatgcttggcacagattaggcactcactgaatacttgcctattatttcagtttactcttactgcatagtgaaccacccaaagcatagtggcttaaaacaactgtcactttatttagctcatgattcaataggtttgctgggctggctcactggagctggatggtctaaggtggttcactcacaggttagcaggctggttccaggggacacaccagttgggccagcttaactgtgctccacaaggtctcttgtcatccagcaggctatcccgggtctcttcacatggaggtcaaagggcagcaagagaggaccagcctcagtgtgcgagtgcttgcccagcctctgctggcaatgcatttgctaagatcccagtgactaaatgtcatcatgtaatcaagctgaaatttcagatttggagaactggacttcacttctccatgggagaggtgcattgcacacaacaggcataggaagcatttgtgccattttcattgcagtctaccaaagtgatggagtaaatgagtcaatgaatgaatacaaggacagaaagtgactcatgaaaaggttctgtgcaagttgagccccagaattccatccaatctcagaacctcttagattcctctatccatggcaggaggcagagaaaagagcaaagccttccaatgagactcagtggctggaaagaggactgcaggagctaggagctcaccaatggttccacgtgttcaactaaacctgggcctcttgcaaactctcttccccagggcctggccccaactaagtgggagaggaaacatgtcagtgtggtcagctggtccctctgccccggatccctgctgcctgtctcttgccctagcaacacctggcccaactgggagcattactccaaatccccactatgcccccatgtgacgcacaacgctgggaagtgtaattgctgtagtgattacttacagccattacattaagttttaaaatgttcccttcaaattgaacaatgttttttcaaagtcaacagctggttcacagcttgaatgcaaccgttaggataaattaaataaaaagggtaataaaatcacagcctaaatttaatttctgaagagtgcataggctccaaaaaaaataagcatttaaaaatgcctttgaaatatagccagaaaagcagaagttaattcactccctgattatgtcagctaatggacacactggcacaattaactacataattgcagtagtatagacaaagtcctgagctcatgcccgggttctgctgtacaggcctcggaccatgggaaggacttaccagataggtggctcgtatatgcagatgtccctacaaataggctcagaaaagagctcccatctctagaagcaaaataacaccaaagatgatatccacagcctccatcccagcacatcttctggttgcctggagctacctggagccatctcccggacaggaaggcagggcggcaagggcttcgtggcactgtgtttgcaaacttcagctactgaatccttttcactcaaaggcaacttactttagtgatcatcaaaaaagacccatccagcatttctcccaggcaaccctaccttccaagcttaggagtctggcaggacttgaatcccacagctgtcatttatttgccatgtcactttggacaagtgatcagctcatttctctgcgcctcagtcccctcctttgtagaaaggaaactcatttgttctttcatacattcaagatatattcaatatatatgtactgagcatctactctgaactaggccctggcacaggtagccaggagatagcagcgaaggcagagatccctgccagaaggggagaagaggtgtagatccaagtagcggagatcaacaatgagcaagaccaggacgtactgtgtatagaatgggagaagataatgcttgcttggggaaaataaagtagggaaagagaataaggagggagggaaggagtgttgtaattttaaataaggcgtttggggaaagcctcacagagaaggggaggttggaataatggcctgatgaagtagggaaggaagccagccacgtggatatctgggtgcagagttcaggcaaaggaaaagtgcaaaggccctgaggcaggagtgcaccaagagtagtccaggaacagcaaggaagccggggcgccagaagcacagagactggtagaaagtgaagtctgaggccagatgtggtagctcacacctgtaatcccagcactttaggaggctgaggcaggtggatcacttgaggtcaggagttcaagacccacctagccaacatggtgaaaccctgtctctactaaaaatacaaaaattagccgggtgtggtggcgcacacttataatcccaacttttcaggaggttgaggcagaagaatcacttgaacccaggaggcggaggttgcagtgaaccaagattgtgccactgcactccagcctgggagacaagagtgagactccatctcaaaacaaaaaca

SEQ ID NO: 1546 - DNA, 2960 bp, Homo sapiens
accatcggtggctctgaaattctctctcagtatttctggggttgtctgttttgaatcaatggtcatgtcatccctcagaagtgcagggagagaaacccaagtccagggaggtccagtggccaggcagaagtcacaatgctactgaaaggcccaactggaaactgaccacagttccagcagccccagtgccctgactgtaaaccccactctcaaggcgactgcatgggtaagggaccgcccaattggatgggaagcaccagaggtgtggagagccagaggggcaggagtttggaagaccacacggacgctgcagaatgttctggagactctgacatcccggaaacccccaagggtaggggctggtggaggggagggcaaagcagggggccgcaggccacatgcttcaggacccagccggcaggctggaggatggtccttcgctgggaactgtctctaggcctcccgaaaatgccaggccaaagaactgggcaggcgcccctcttccgccagtgaccttgacccaagctgggctgggctttcagatacgacacggccccttcccctcttatcctcttcccaaggtcgtaaaatgagtcggcttctgggtggcaggacttttgcagggaccctcgtttgcagttcttgctggggctggagcggtgtggggcccgtgactgggcttggcgtgaaactagaagcggccagggcaggtgtaaattatgcatagctatttctggaaacttctcagatttctcaagagagagaaattaatttgcctgtttgggcaaataacaccaatttttttttcccctgcttaaggtcattttgttaaaataaaattgattaacgttctctttaaagtttaagtagaaactgctcaaacatatttttatgcatagaagcacggtttgcgcccttcagtaattaataactccacaaataaggtaacaccaagccgctcgcagcgcactcagcccgcggcccccaggtgggtggggccggcccgatgcgggccaatcagggctcaggggagggaaggggcgggccggccgcgcaccaaccccaggctggggccgccccggcgctgtcccggctcaggcaggtcaaggatccgcccagctaggagcagtccaagtagaggctgaccccagtggactatcacctggaaccaaccccagtgatgagagtatcaggagctaaccacttctctccttctctccttccctccctcccttccctccctccctccttccctcccttccttccttccctccttccttccttctctttctctttctttctttcttctttcgagacagggcttcgctgtgtcatccaggctggagtgcagtggttcagtcacaactcactacagcctggaactcctgggctcgagtgatactctgcctcagtctcccaagtagctgggattacaggcagggcaccacgcatggctgatttttattattattattattatttgtagagacagggtctcgctatgttgtccgcactggtctccgactcctggcctcaagtgatccccccatctagacctcccaaagtgctgggattacaggcatgggccactgtgcccggcctggagctagccatttcttatgtgctctgctcaagggcttcttggggctgggaacagggctttggaaccggactgccagcattagaatctgagcattgggcaagttagcatctctttgccttagtttcctcagttgtaaaaaagagataacagtacccacgtgataacgttagttattgtgtggattaggggagttaatacacggtgcctaggagaataccaggcaccaataatgttattaaacgtcaccgtcattcttattttaatttcacaactttgtgagataagtattattttttatttttcccatttaccaatgaaaacactgaggctcagagaagttaagggctttatttgaggtcacaccgctagtaagtgatagagctgaggtctgaatccaggtatcatagtccgcagagcttaggctacaagttgtcttcatatacatgcttatcttcccctagaccttttaaattgtcatggattcactttcatacgcaatatctgcattcatttagtaaatatcttatctgctccagatcctatgtagggtgctggatataagggcatttactaagagtcaggctctgccctcaaagatagtcagagacaggtgggtggaaggtggggacagcttgggtagtcattagtgcagtgttccaagccttgctgattctcacttcttccaggcacagggcaggattgcacttcctggccctgtgatagaatggggccatgtgacaattgctggccaatgcattgtgagtctaagagctctgtatttgtgtaagtcccaggcaagagcactgaactgccagttctctctctctctctctgcttggttgctgaccatatttaagggggtggctgctccctgatcctaacttctgagtgaccttgatgtgttaaggaagccccctgggtatccaagatggctatggaatatgagtcagaaagaaatctttgttgtgttaaaccatgagaatttgggtccttttgttaatgtgccatatcctagcctgtcctgactgacagacagtcccacagacaaataggtataaaaggcagtactgtgcatgcccagggatggacttacacaccaggtagtatcagcgttcttattatgagagcattttacttagctgcgggggtcaaagtggcctgaagaataaactgggccaagactagggtgagatgaatgaggcacttcctttgggaccaaaatttaagtgaatacaaaacaaacaaacaaacaaaaagccagagtaatactttcatgtttctgaaaataaaaattaatgtaaaaaatgatggaaaaaaatggcaaagtgttaagtaaagacagaatctgatgctacat

SEQ ID NO: 1547 - DNA, 2166 bp, Homo sapiens
aagtagtgcctgtgaagaccttaatatagtgcctggcatatttgtaagtgctccataaatgttaaattagaataatggcagggttactactactattactgctgctgctgctgctgctgctgctacaactactatagtactgtgactactactactaataaagttttgttattttaaagtgattttgagttcctaggagcactgggtattcaagtcttaggtcattttggaaggtgtaatggagttttgatagttgaaagaggaaccatgaatcatgcttatactgttgacctgaagcagattctaagtttctcatcctttagatgccactagtatagttttctgacatgttctgggcagcttcagattatgtcagggagataaaatactgaatgtttgattttcccgggaagcagaaaggcactgcaacatatgggcattgccataaacagattttatggatggaccttggctgttgcagggcttactagctctactcaagtatgattgattctatcctgactggattttgccacttggaatttcttagtagaggagaaccttgttatgagagcatcagttatgattactgttaaaagaaaaactttaggcaaattaaatttagcagaactggtttgaacatacagcaatttatgaattgggcagcattcagaactgggagtgctccacccagcaaggtaggcaagcagtatctatagacaggaaaaggaagtgatgtacaaaacagcttgattggttgcagctgggcatttgccttatatgggcatggtgtgatgaggcattttctttatatggatatagactgatcagctggtagactgtgactgactgaagcctggctgctgtgattggctaagacttagctgtttgttataaggatatgttgttaggttgcagtttgctacataggaactcaaagtacagaggcagtctcaggccaaatttagtttaactatatgttaagctgcaggtgacagaatacctccatctatagaggtttaaacaaggaaagggtttattttttcctgtataggcagctggatgtaggcagtgtagggtttgtacagtggctacaagaggccaggaggggtctcagctctgtctcattctcttcctgttccatcattcttagcctgtgacttcattcacatggttggttgtctcatgatcacaggatggctgctccaggtgcagcactacttctgtattcccggattcgatctatatacccaggaaagccatctgggttctctcctttaaaaagcattcctggaagccccacctgtcgacttccccttatgtatcaaccatgtgtatgtcacttgaccaacccacttgtatgttgtttgaccagccctggctgcaatggagagtgggaaatacagttttttcaccaagtgcatggctgtccaaatgaaatgagacttccattaataaggaagaaaggaaagatggagatcaggaagctgggggatcagggaacttattacattgagagcccttggagtgaattctcttgcaaatatgtccctggaattgagaatccccacaacgtactttatctgttctttctttatccatgagtttgggttttcagatgttggatttcctatatggggggcatgtgagttcatcatcttccataatcaatgttgtatcaactggattttctctcttcttctcaccagcctggaggagaaccatctccaggatgaaggtgtatgttctctcgcagaaggactgaagaaaaattcaagtttgaaaatcctgaagtaaggaacccataagcaggaaacaggacaataattgctggcctttggaaggggcatttctgaataagatctgggccgctctccgctgggctaactcatgtgaggtggcctggtagaacagcttgccttggtctaggtggacaaggattccagtgcaagttgtttatctgggaggtggtcccagtaaatgctgataggagagtggtgaagtgagatggggaagtgaaggtaaccaataaaggggagttatcaagccagttatcaatgagggaaattggagctcagtactctggggcactcctggagccagtgcagaacacacatggtcacctacccaaccaatgggcaagaaagccatggcatttatccacca

SEQ ID NO: 1548 - DNA, 4694 bp, Homo sapiens
tggtactaaatgcaagtagaaattaaaaacaaccagttaatcataaaattacttgttcatctggctcccctgctagactctatgctccttgagggcaaggcctgtggccactctggtcatcattgcagtccagtacagagtcagaacatactagttaacaagtaaatatttttgagtgtgtaaataatgaaatgaacaagttaatgaatggatgaacaacttaagtgaaattagaaagataaatcccattggaagaagaaccacatgatagttcaaaagtcaggaatcatggggataaaacaggtccagattctaaaaccagactgcctgagtttgaatctgggctcttcctcttaccaaccatgtgttcggggcaagtttcttaaatttgggataaaaatgggatgataatagtattttcctcaaagggctgctatgagaattaaatgagattttatacataaagactaagaatggtgccgtatacatagcatgtactatatatgtgtttaccgtgtcattttattatctctacatcaattttgctctaatttgtgaagataaagaacactgagcccatagcaaactcttccaaatcagtattgcctttgaggaatcatagctagaatgtcaacggtcaaactcaacctagacttaaggatagggcggaaacttggcaaatgcatacaactcttgtgctttggcagttggaaaaagaagaagaaatgttagaggagaaatgtaagctcataattataacataaaataatatctgtgaatgaaaaggaaattggctcacaggcaataacaagatcaagaaccaagaagtcccattttgttgttgttttgctttcagctttgttaatgttgttttaaagcccattatgagctcctcaagattccagaaattcaccaagtcctgatccaggtcttttgaaatggaggaaaggggaacaaagaattccaaccctaaaattctactatgggctacctggagggggcagagctcccctgcttctttgcaggccttcatctctacagaaaaggtcaggcaaatgggtcccacatcattcaatcctaactgctccttcatagacttcagtttctgcctaatgtgcttgtctgggtctaatttcatgatgaatgtgaagaaagagtgagtgagaaagaggtgtttataaggaaaacctaactagagaataagccagttgtcaagggtcagcttttacctagttaaaatgaactagggtcagttctttaactggactcagataaattagcaaaaatacctccatagacacagtgtctcccatcaggatataatcttatgcaatgaaaataaaagagattaattttattgtcaagggaaatatcctcagattccagcatgacgactatattttcaccatgggacacatttttttttctattagctgaagctcttccaatgcaatattctactgttgtctttgaagggaaattaatatattctcaccaagtttctgtttatttgggacataagacgtgggcagagaggaaggattttcatgcaggtgttcaccataagaaaatttcactcattccctaatggccattgcaagctcttgtggccaacagtgcctttagttaaacacatcacccttctcagaaaaagagtcttgaaagtctttctagcagaggcagtggttggttgcctttccaccatcttaagggaaccatatggaatcatgattgtcttcctaaattgttccttttcttcttcattcaatgatatcgagtgagctcctactgggtatttcaaataatagaatttatctgcaaataaaagttgcatctactgaaggcatagaagctttagtgccactgttggatctgggcaccctgccaaggctatgttttagttatgttgagctgttttcctgggtgaagccatcagaagtagcttctgtccctgctcctgccataagggattagaacaaggtcatcgccaaagggaagtgcataaggaaactcagcagattctgatgcagttgaaagggaatttgtccagtagaagctccccattactgagaggaagaagacgacccaagataattctcactggggaaagtgggaatgtcaggcaaacatagaaaatggcagggaattcagctcatgttcctacccttaaagaagatgaagactcttttttttgagtggggggtgcttctataggcacccatgagagaggagagacacccaagagaggacaggctcccataagagaggagagacagagtctagagtgttactgtggctgttgggacagattctagttccacccagggtcttcacagatctttcaataagttttagtcacccaaagcaattgaaaatggtttggttcttacaccctcagctacttagctgaaactgttagagctatccaggactaaagaattctcctaacttcaaactcaagaaaaccccagaaaaagtgtgtgtcaggcactgaggcccaatgctttaggtgcattatttcaagaggtttcccagcatgactttgagaagagtggcagtatgcatattttacaggcgagaagcttgaggccttgagagattcagtattttgcctaaggtcatccaagcagcaagtgaaaacacaaacccagactgtgggactccagagtccatgctttcaacatcgtgggttaatccacctcatcatgtgtgtgattttatttaatcccataacaaagctgtgatgggatttataacctctcctttagatataaagagaagttgataaacttgagtcagtgacattgctagaatggggaccccaggtttacctcccttgggagcccaaacatttaaccactctgcttaaagaaggaaggagggagcggttttcctgagtggagtacaacccagttcttcaaggacacatctttaccaagaatactggtggtggaggttggttatttgcatcttttattttaagcaacacagaggaggctgtggcactgggttttgcatttcctacccatcatcactggatattttccatgggagcctactgatccctggcttctggaattatttcatgcaaaacacgtccagccagagggtggcttaattgtcagaagctcaatccctctgatattttaagtttcgtttctttttttactattattttaacagttcgtctcggttattcctcatttaacactggttcagttaatggaaaagaaagcacttaagagaaggaatgacctagctagtgagctggccattgtatctgaaataaaaatcaattgcccactatgcagattgcagaagaagctgcaaataaaattactgtaaatttaattaaaacattccagccaagtccatacatttggtattgattacctggcctgcaatttcagggagttaattaacacagcctccgcctggacaacaagggaaagccagtgcgggtgctggttgtcctagcaacaggtaggcggaagcagctcacagattaaattgaaaggagatacagaatcttattgaattagacttaaatgcaatgatttaaaaatatgaagaggcaacttaaagttcaaaacacacttcatgagcatgagtcattgtgtgtttctaattgggccagaatggagtgtttctactgaagaatgggaagatggagtggggagggtgaaggtggggttgcttcagataatccattaccatgagagtgctccctcagcactgcaggctcagggtaccgactcctgcaagaactcgtttggaaaaagaaaataggcctcatgaataatctcctagaaccataagtagaatgagtaaatttattttcccttccctagagcagaggcaatgggaaggaagtacattctggtgaattggttcctagaatcaccaccatagaaactgtgtctataccctgtgttaatacacatgccccaggccgctgcctgggtgtgcacccaaggctctgtttctggcttcgtttatgttagaggtcttgattttttcagccaaaagtagatttctgaattttgtgcttaggtgtgggatgattgatgatggtagtcccaaagaaaaattggccatgtactcacaaagaagtgacatcatttttgcatataaggaactgaaccccaccttcaccagcaccaccacccataacacacaccacctgttcatggatacttggaaattcctcattgagtgtgatattctagcttagagctttgcaccctcttaattagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgcaagaacaaaaaac

SEQ ID NO: 1549 - DNA, 2662 bp, Homo sapiens
tggcccatgggtggtaatttgctgaaacttggtttaaattattattagtatctacctttttttaaaagatgatgttttttagggtctttccatcatgaaaattatgtttttatgaaagtgatttgggaagtattaaaatacagaataaagagcaagccttgggctatgaagtcaaataggactgggttccaggactgctgtgtgactttgggaaactgacctgccatctctaggtgttagtttcctcacttgtaaaattaagatgctgacagccctcacctcatagggtcactcactgcaaggaccacacaagtgaacatgcatacagcacttagcatagttatggataaccctgtacctaccttattatagcaattgctatcaactttcttctagcttatcattaatgatactataaaaacacccagcataacgccagcataaggatgtgaatgaatgagcaaatgaaaggagggagggcaatggcaaaattttaccttggtttccaagctaaagtataacctgagttttttaatgctttacaaaaaggaaaggcaatcagaaccataattaatatttaagctgtactgacaggttttccagggaaaattctatagaacttgttattctccaacttccaaaaataagcaataaattttttttaaagagctgttattttaagactttatttgaaccaaagaatgtgtttatggtaacaacatacatgttgtaaattaatcagtttcaatgttataaaataatacttccaagaataaatgtatcatataatctatgtacctcatgtcgataatttaaataaatacattaaataaatacatcattccgaagtccgctttatcattgtttgtaaaatccaattgtcatactctggtatttgttctccaaaagaatcatcactttcatattcactacagcatgagatgagatatttaataaataataggacatcataatccagggattaagtagtttcttttagcaaaatttaatatgagggtagcatatgccagccgttcctagttgagcaacaatttctgtgttgggagaggataacaaagccaagtattttcccataagaagttcacactctaaaaggccaggcgcggtggctcacacctataatcccagcactttgggtggctgaggcaggcggatcactaggtcaggagatcgagaccatcctggctaagacggtgaaaccccgtctctactaaaaatacaaaaaaattagccaggcgtggtggtgggcacctgtcgttccagctactcaggaggctgaggcaggagaatggcgtgaacccaggaggcggagcttgcagtgagccgagatcgtgtcactgcactccagcctaggtgatagagcgagactccgtctcaaaaaaaaaaaaaaaaaagaagttcacactctaaaatgaagagaaatgagaaatgtctatgtgcacacaacttcccacatacacacattagttagagaccacagtcatgcccaccctccagctcacgtgacatttcaaagcagagatgagacttaaaggatggaagaaatggcgtttgtttcatggatggggtaacggaggcttttaggggcttatgggatggacaagtaaaggatcaatgagacagaaaggcaaggcaaggcaaggcaagggactcgatctcaggaagtggtgagtggagatgaaagaagtccaatggaatggcagtcactggagatatatttaaagaagagggtctttttgtttgtttgtttgtttgtttgtttgagatagagtcttgctctgttgcccaggctggagtgcagtggcatgatcttggctcactgcaacctctgcctcccgggttcaagcgattctcctgcctcagccacccaagtagctgggatttcaggcccgcgccaccacgcccggctaatttttgtatttttagtagagacgggtttcaccatgttggccaggctggtcttgaactcctgacctcaaatgctctgctcatcttggccccacaaagtgctgggattacaggcgtgaaccaccgcacccggccaagaagagggtcttttaaagaagcaagataggaagatccgttaaagagagaactgcataggaaggaaaaggcctggctaggattccctgaaccttctcatttcactactctcttgttagtcatcaatgcagttaagaatcaacgcaatcaaatcgaatcacatagtgattaatttgtgccaccaatagctctaattttgttaacttctcattccaataaaaataatcatctggttaatccatttcttcagcgggattacttgtttgcttgtttctttagctataataaactctgaatgccagagtcaccaaactaagcattaaacaaactgattgacaattcggaagcataggaataattacagatgatgctaggcaatatcactagattgggttttcatgaagctcgtgactggattttgccacaaaaatcactaactgctttggcttccagagaatggcctcatggataagccccaagttccaaaaactacaaaatgtcaaaatcacattcaactaattaataattttatgtcacaataagaattaggaatctctagaaggctgggtacagtagctcatgtctgtgatcccagcac

SEQ ID NO: 1550 - DNA, 1845 bp, Homo sapiens
actagtgcctgagatgttgaagattcaggtagatacaggtttgactcctacctgtacaaattgggcctcagctggttccagcaccatggtcaatgaggccaggcttattcatccccaaggaccaaagaaggtcaatatgccatataatgctttataatttgcaaaaagtgctgaaaaatacgttacttatttgaaacccacaacactcctatgggttaatcaggctaatgtttatgtttccatttcacagataaggaaaactgaggttcagagaagttatgtggcttgtgtaacatcaccagctacaaagaagccatacagggattcttaaagagggagctgcatgttgtctcctgcatgttcaatgtcctttgatcctgtgcactaaatagcagtggagaccccctctcactcatccatccacccaatcattttgacaaccagatgcatttccaaactcctctgggggcgggagtggtgggagggagaaaggacaataacacacacacacacatacacacacacagtttgaaagaaaaaataacctatccatctgctccctccctgaattaatttgttcatggagcacttcctcttggccgggcacttgcttgatgttgaggatacaaagaagaatcaaacccagtgtctaacctcaaggacctcctagtcaggtaaggagcttgcaatccctgcaatatctggagaaaaaatttacaaagatttcccaggcctgctctcatgcaaaaaacctacaatgtgtcacatgaattccttcccgctgatgataaacaaatatcagaaatctgaatacacaaacacaccatacagaagagatttctggaacctcgggcaaaatattataatattttcatgggctgcccaaattctaagcattagatttgatgaacagctttattgaattttgtggataaatatttaaagccttcaagggcttgtgtaaatcacacctaggcagacgcacttgctcacagcaccatctgctggtagctgcttgtgttgtgcagggaagttaatgggtatccaggactcaactggggacaaaaaagtaggtccaggagacaggccatctgcagctggccctgaaacccagaccgtgtacagaccaaccccaaggcaccaatttccagaagcttcaaagcatccgagagcaaaaattttcagaagcaacacgagatgacggaagcagaaggaagagaatataaaggatatgcaaggatttcttgttttcagaagtttggaaacctagtgccctccagaggtcatatagcccttgcccgtgctccaggtggaaatgtacctaggacccttaaaagaggcaggagtttgcaatcccccagggtccaacctcccagggtcttttgttacatggcttataattctttcctgacacttatcatatagagaaatattgcacagctcttttaaaattatgtcctaaaagcacatttaatggcatggtcagattgtatagtgggaaaaaaaattacaaaacagagtgtgtgtgtgtgtgtgtgtgtgtgtgtgtgtgcatgtctatgtaaccaaaagggtatgcaccaaagtattcacaatggtcatctgtaatagaataaggatgactttttttcttctttgtgtttgtctgtattttccaaattttctctaataatgccaggcacagtgactcatgcctgtaatcccagccctttaggaggctgagatgggaggattgcttgagtccaggagatcaagaccagcctgggaaatatagcaagacccatctctactaaaaattcaaaaattagctgggcatggtggtaaatgcctgtagttccagctact

SEQ ID NO: 1551 - DNA, 2116 bp, Homo sapiens
gtgacaagtggcaggcaaagacaaaaaggagttaactgagagaagagctatggaggtgcagtgtgctggagagaagaggtttcacagccaacagggcagcatgtgcactggccttgaagtagaaaggagctccgagggtccttttcaaggtgacctctaaaagggaatggagggaggatcctggaggagagaggaagggaagggcacagggaaagaaggagttgaaccaggccagggcgatggcaatcaaaagtcaccttgagaaattgatgagtaaaatcacgagccacttttgcaaagctcattgtagaaaccccacagatatttaagcctcatgctcaccatttccaaatagaatttttatctcatgctgcttccaccaattccacttgttttccatgttctctcctgactttctggaggaggactggcttgaaggaaccctcacctctgcagggatctagcgcctgctgtgtgaaccagttgcagggcgagatgcaggacagggaactagccatggtccttaccttccaggagccctgttctggcagatcacagcaatgggaactgtcaaggcttcaaccctcctgccaatatcctggtcacccttcttctggggacacaaatcccaaacttcagaggcttttttgtgctccttcttccttaatccccatggctaatctgctaccaagttctccaagcctacctgcaaaatattctagggtttatctacttctcttcagcctccttgtttcaactcttatcaaagtaactcttcaacttgtaattcaaagtaattcttcaacttggtaactgtaatcacttcttcactggtgacctcaaattcactccgattcccccttcatgagggcagccagagtgatttcttccaatagcaaatgtgattatgccattctctactcacttctgagatttccttgctcttaggagaaggaaaagatggtcttggccccagcccacaaggcattcgttgtaagatccagccattcattgtgagatccagccattcattgcccaccactccagccctcatgctcccaccaggcttggcctcgctctccaccttctcaccacactggcctttgcagagctccttgaaggggctgagctcccacctgcctaacacccagacctgcactccaccgtcccttcctcagggcaaagtcccagaatgccagaccacatcagttctccctatcatccccccatcatccttccaaggagtggtcttatttttatgtgtttatttgattaacggctaactaatcctacttgatttagagctctttgagagcaaaggtgattctcatctctgtgcatgtctatggcacagggatgagaacactgtctggcacagagtggctgctgcaatgaatataagttgaataaaagaacaaatgactgcaatggaaatgagtgaagaatctgtccaccttcccagctttcttgtacaggaagactttacaatgacctgaaaggcccgacatggtatacaccccttccccaagtccccctttctctggcgtctgatcgacttctctctctagcacacttgactctggcttcactggtgttctcgctcttctgcagcaggccaaatatgttccagcctcagggcccttgcacttgctgcttctggtgccaggaattctcttcttccaaatatccatccacatgactgactctctcccctccttcaggactctgttcatatcattcttcccagtgaggtcttctctgatctccctacataaatccatcattttcaaaacccctacccgatttatttttcctgatagtccttatcaccttgggcatattaccttatttatatgtgtatcatctatctccctccaccaccatgagaatatgagctccttaaatgcaagaattttgcttgttttatactctgctgcatcctcaatcctcattacagttcctggcatagtaaaccctcaatatatgtcagtggacaggtgaattaataaatgaatcttgagcctagaaatgacctgggccttgttcttggagatcccttccctcttgaccttgtggcacaaaacaaaacaaaacaaaacaaaacccttctattcca

SEQ ID NO: 1552 - DNA, 2054 bp, Homo sapiens
aaaccagaaattataggaaacatgttatttgattcttagtcatggaatgtttcactgttgtgattgatgaatcactgcccacagctcttgggacaggtgttccctattctctctgtaatgctctaaaaccccacggaatgcacagatcatcacatataaataattcaaaaacaagtctcagtaaatgcttcttctttcttctgtttgaaatgttaatttcctttttgaagtttttcccacttgatagcaggacgcagttttgcttgttttattgccaaagatagactggtagaactgtgtgaatgccttctgtgctacagagaatgggatttccaaattaaaaaaaacaaaacaaaaaaccatatccattgtagccaggtttttcaaccttcttttttatcctttaaaaattggatgtttttgacaagatctaaattcagcttcattgcaaataaaattatatttcttgtagaaaaattatatccccaaactctcacataggtatttgccatgcatgtatagtatctattttattttgtttatataatcttacacatttatgttaaatatctctatatgtcttcattcaaatctttattattatattcgtgaaatcctttagattaaaaagagggggctttttaaaacattaaaaaccaaagataaaataagaaatctcaagctctgcacctttctttggcactaatggtagaacacttcctagcagaatgtcgatgttataacaattatgcagttctggcaagcataaggaatacaacttttaatttaatcactaattttggtaatttacccaagaggtacgaatggctgtattgtatttgaaatcttctagaaaattgatcgtctcatctttttcttagagatatttatcctgtccaaatttgcttcagagtatgattgagttgagatccaccagggagtcagtgttaaaataaataatggagacagtgagaagtagtaagtaagagtgtgggtttagatgtatgtttcaatttaatgctcaagtgtggatgcaccgcacactcacaggatgaacaggacctctctgaaagctaaaagggccacttggctcctagtaagacaataattgataatatggaactctgagaggatgctagtgtcaccatatgaaagaaccttgactttggagaaggtgaaattagaaggtgaggatttgcatcccagctctaccacataccagctgtgcaccattggacactttctttcaactatttgagataaattgggtataaaataagaaaaaattacctatgtaatcaaatattaaactattgatatttgattaatattaataaaatattatgtgcatgacagtcactagacaaattagttaaaaatcccagattccacattgcacttcctaaactttctgatcctcagaatctcaattttcaaaaattacccaggcaatgatgatacaacaagtccactgtccactttctggcaattttatggtcttggtgattgtttttagcttatcaagtgagacaaagttatcaaaatatcttgttgctttgcaacttgctaagcctgttttgtggcaatgttttgatttcttttattttcctgattttctgacaatgaattcaagcaacttgagcaagtagtttcacctttgtggctcagtttacatagtgataaaatgagtaggttgagctagttcaacagttttatatcaagctaagtttttaggttttatatcaagtttatatcaagctaagtttttgggttttttttaatccccatgtttgattatcgcattaagttgttgatgctgtatttatgtaaaactccatgtttatgtgtgtatatgttactatcatgatagtgggatcacttttggaatctttccagaattgtagataatagaattaattttctgtcaaaaaagtttaaccaaaatttctttaacaattgaagtagaaaatgctgaggttatgattttctcttgtataattaggggaaaatgaagggaaagaccaattttccaaatgacttcaatttgaatagga

SEQ ID NO: 1553 - DNA, 1224 bp, Homo sapiens
ggtctcgatctcctgaccttgtgattcgcctgcatcagcctcccaaagtgctgggattacaggcgtgagccaccgcgccccgcagctgtggttaattgattactataaccaataatgtcagaatggaggagagtaaacttctctctcaggtggtatccatcagtaaacaaggaggcaagcagattttactaaaatgtaatacatttcatagtttctttccagaatcaggtatcataaaacaacatcaataaaattcactttccaaattttgtccttcacagtgccctttcatattctaaaacaaactgacaattaagacaggaattctgcgaggtcgaaacaattttcataataatgccaaaatattacttatgttaccatgcaatgggtccatcactgctattttcaaaagaattcttttaaactatttcacaacagtctggatctgtgtttttcctgagggtgaagttctgcgtggtgagggcattgacaaatcgccagggacttcccataaaacacacattttctaaaatatttaataattcattaataacattttgtctacataactttaacctggggaaggctgagcatctcttccaatctgacaattcttctcatgtaaatcttataataggaacgcaatcaaagaaacctagcatctctcttctcataaggtggaagaacaaatctcggcgattttccaacgctcctctgggaaattattgtaggtgtaaaagatatcccgaaaattccttttcattttttttttcctgtctaatttcgcaaggcaacatctaaagagttgtcagagatttagatgcttgattaatatgtgctcatgggtggctgagaaacaatctttggtgactcatttaattaagtgataagaaagcatttaaaaatgaacagacccaagagtattgaagatatacgtccccataaaaactcacacacaaatgttcctagcatcattcatgatagctacaagtgggagcaatctaaatgctaatcacctgatgaatggaaaaacaaaatgtggtatacccgtacaatggagtgtcaatcagccctaagtggaacgaagccctgatacatgctccaacatggatgaaccttgaaagcattatgctgagtgaaagaagccagacataaaagaccacgtactgtacaattccatttatatgaaatggccagaatgggaaaatctacagaaacagaaag

SEQ ID NO: 1554 - DNA, 1498 bp, Homo sapiens
cagtttaaagcagaagccaatgcaaagcatgagtttttcctacacattctcaaattagcaactactgaaattgtactacatttcaaattcaaggaaatgctaataatcaaaaggttatgttttatggtcttaagcatccagaattactaggtctaaagatgaatgtttgattagaatcttccatatcctcaatgatgggaaaatattggcctagctttaaattatttcagcttaaatttatcataggtttgcttgggtaacagggttgtggcagaatccaaaattcaagtaactgagtatagttaagtgctggacttcagaccagcctgattttcaatccttgaccaaaataattagaagacagctgctcagcctctcccaaaagaaaaattcctcaatccaaattaaagtatttatctaatatgaatctttctgtacagtcagaacccttcaggaaatagcagcaagttgcctttttaagaactttaatcagaacataaaaatcgcttagtgctatgattaggatgaatgacattcttccctgatgttaaaacattttgagatagtactttccaacacaaagaacctaagagtgaagcagcacacagcatttgcaaaggatcaataagatacagccccagcgaggcgctgtggctctcacctgtaatcccagcactttgggaggccgaggtgggcggatcatgaggtcaagtgatcgagaccatccttgccaatatggtgaaaccctgcctctactaaaaatacaaaaattagccgggcatggtggtgggcgcctttagtcccagctactcgggaagctgaggcaggagaattgcttggacctgggaggtggaggttgcagtaagccgagatcgtgccactgcactctagcctggcaaaagagcgagactccgtcttaaaaaaaaaaaaaaaaaaaagatacagccccaaatttggctcacaatttatctcagtgtttataaaatctagatttttttacctgatctcttaaatgactgaagattaattaactttgataatttgatacaatatggaaactacctacaggtaatatgcaaaccttaatttattcattccgtaacatttgacaaatacacaaaataatattagtttaataaaaagtctgttttggtaacagttttcaaaagaggaaaaattttggctgggcgcagtggctcacatctgtaatcctagcactttgtgaggctgaggtgggcagatcacctgaggtcaggagagcagcctggccaacaaggcgaaaccccatctctactaaaaatacaaaaattagccaggcatggtggcacatgcctgtaatcccagctacttgggaggctaaggcaggagaattccttgaacccaggaggtggaggttgcagtgagccgagcgagatagcaccactgcactctagcctgggcgacagagtgagactccatctcaaaaaaaagagaaagaaaagaggaaaaattttaaacc

SEQ ID NO: 1555 - DNA, 1630 bp, Homo sapiens
atctagagtcagactgatcgtacaccctcagtcttccagttggatgtccttggctgggtcagccattctctctgtgactcagcttccccacctataaaatcaggataatttagctcatacttaaagggtagttttaaagattaaataagatggcttcttaaggattaactgagataatacattttaaatagggcttggcaatactaagttcttgataaatattagcttattttgtgataatgatggtcatggtgatggtgatgatggtgttgatggttgtgcggatggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccaggtttgtggccttgggcagagcataaaagatgtcttggcttattgttctctctatagtgagggagaatagtgggttctggagctggactgtctggcttacaagctagctccaccacttagcagcaggatacccttgaggaagtcatgcaactcctcagagccccagctttctcatctgaaaaatggggatgaaaatagtaactgccacatttaggtgttttaaggaatggtaaaatgatctgcataaaactataagcctcattcctggcacatggtgacctcttaatgaatgctagatatcctcattttgaaattaagaggtgccttcaactttacttggtggcttttctctatacattgtacctttatttttactttggaaagttgtatgcagtgccccgaatgctgacttgtaaactgatttgaacaccatcctcattccttttggctctctgagaaatgttcttttttaatgaatatgatagcaagacttacttattaccaggttatttcaggcaagagtgatttttaactcattaaccagataattattgcagttctccagttacctttctgttcatagacttaataaggcctgaggttatgtggcagagttttcttggctaagatgggagaattattaaagctctcaggtgaaggtgtgaaacctttggtgcacagagggtggccgtgccattcaagcagtccgtgatggtgagagggagctcagctgcttagggaactggtacagggtttcattaatcatgggacatttctggtgtacttgaaaatgttagttttacttatgggaaagatatccagacgtaaatgtgtgtgtgctgtgtgcatgtgcgcacggtaggttatacagcaccaaggggtcaaatagactggttgactgtatcctgtagtggtttggagcaggtgttggcaaacttttcctgtaaagtaaatattttagccttggcaagctataagatcttcatcacagctactcaattcagccaatatagtataaaagcagcaagaagatacatataagtgaggatgtgactgtgttccaacaaaactttattgtggacattgcagctggaatttcatataattttcatggaccacaaactgttactttcttttgacatttttc

SEQ ID NO: 1556 - DNA, 2485 bp, Homo sapiens
agtgtaaagttagagatctgatgcaatgatattccgtttgaaaaatcccgaaaggctaatgatagggtttggctccgagtccccacccaaatctcgccttgaattgtaataatccccacgtgtcaagggcagagccaggtggggatcactgaatcatgggggtggtttcagccatgcggttctcgtgatagtgagtgagttctcacgagatctgatggttttaaaagcattgtctggcattttctctgctggcgcttcttctcttgcctgctgccgtgcaagacacgcctttcaccttccgccgtgatcatgaggcctccctagctacgtggaactgtgagtccattaaacctctttttctttataaattacccaatctcgggtatgtgtttatccgcagcgtgaaaacggactaatacagcttcttacaaatgcactcacagagcagagtgcctgccccccgagacggcctggtagcggctcctacggagtccgaggtggcctttctgcctgtgcctccccaccagggccctccgtaagcactgactggggttgggcagagggcgctgcagcctcgctcgtcacccaaggcgggcagagcctcctggcctctgatagcggctctgcactcctgcgtcctgttctccatggtctggggatgaccagaggaggacgaccagctcctccctggccacccctcctggcctctcccttgctaaggaaggtcaggccgtccaaggcgggtagggagatgcatcagaactcatgggccccttgctggagctgacagagccatcgctcttggaggcagctgatgatccaggcagccctgtgccaccaccacgccacgctcagcactcctgcagccaccagcaagcagggctcatggcagaaaaactcccagaacacaccgttgacaattggagaagaaaacgcctgaaagagcaccggtcatggacagggccagggaccagtctccaaacacttttcctgtgccaaggtggggcagaggaggctggaggggtgctcagagctgtccaaaggaacaaagggatggggacaggttggcagagccccctcccgcatggcgtcatctgctgccccttccttcagatggagcaggaagggggcagtgaaggaagtggaaactgcacaccgcacaccaactcagctttttgctgcttggagctcaattctttgctaactttggatatcccagaagagaggggttttttgtcaagacattaaagacattatttttgaagggaaacaagacaggctattcatgaacagcagggaagcagcctgtttcggggcccggcactcctgctgtgcccgttaatttgatttaatgagatgatgaggctgacttggggcatccattctcggccactgggcccccaccttggtgctccggagagggcattaacgcgaggaacagccaaactttgaagctttattttgtttcctctctcccctctcccaccttctgccaattaacacgggggagaaattacatccaggtgcagcctgtcgctggcaactgccagctacagccatcttcctccctaagggtgaggggaagcagtgaggctggagatggtggcttcagggcccagaaaggtgccaggtgtgccactaacctgagtgcctgatgtctgagccatgtgccctggacatctggcgtgctctcgggccacggggttgctccactcaagggcctttgtatctgctggtcctgcagtgggaatgctctccctccagaactctgtgtggctgcctacttcttgtcatccagatctgagctcagacggtaccatcttccagaggcctcccctgaacacccacatctaaacagagtctccccaaaatgaatcaccttccatccctcacctgggatttatttgtgtgttcttttttctccatggcacttgtcattactgaacacacagtatttgcttggctgtttcctcacttgtttcctgactcccacattagactgttgactacacacgagccgagactgtgcatattcgttcgcttccgtatccccagtacctggagcaccaccaagcacacagtaggagcttaataagcacgcactgggaaaatacatgaacgagcaacactgattgcacctgtgcatgccacacgccaggctctgtgttagattccgcacacacacgcacatgtgcatacaaccacaggcacacacacgtgtctgtcatggacttacctagctatttgctgaactaaccctcacagcagctctttgaagaaaagatcataaatccccttttacagatggcagagctgaggctcagagagaggctatatgacttctcagtcacagctgggggttcaggtctggggccagggcttcctgatgccaacattcccctcctccctcccgagcaccctgcttcccctcccgtgggtgctgtggcagctcacctgccctgcccctggacccccgcagctgggt

SEQ ID NO: 1557 - DNA, 2424 bp, Homo sapiens
atggattgggaagctgtagcagagattgctaggctagttccctactttatgtccagtatctttttcttactttaaaacagaattcttattgctagctgagtgcactgctgaccagaatgaaaatgtccttcccagcttccctgacaactctatatagcaaatggggtgtagctaaagtgtgtcaaacttccaggaagtctctttaaaaaggaggaagttccagctgccatcatggaccaggaggttgggtgccaagcactaggatggtagagcggaaggacagaaagaacttgggtctctaataactttggagctgccatgccagtcctgggatgccttcttctatacttcatttataggagagagtaataaatgtctctcttatttaagctactaattcagggatctgtttcattagaaggtgaatgcaattcctgatacagaaattatagaaggttctggaatttttatttctttacatggcacattaactaccaagtttagaaaacaaaacaattctttttctagttaattgactaactgtagttaactgaatatttaaaagtctttcatgaaattcagtgttcaactgtttcttgtgtcctgtgtcttccttccaggttcacttttcttcttgctggatgaagcaggctgcagttgacatgcaaagaaaagctgagatacaagagtgaagagtcctaacggcattccagcctccagtgccagtgtccttacccctgcctttctggaggtttgattatataagccaacaaattgtgcttatatgcggtcacttgaggccaaagaatcctgacaaaaggagatagaaagcgaccgcacagatgtgttcctgtggcatttgcctaatttatctatagtgaagtaaccagaaacagtatggattcaaattcttagagaggaagttgattttttaaaaaaagataacgaagaagaaactacataggagaagcaccagaagagaaagataaaaatgaagaaactaaaaataacatggctcagaatgctgcctaatttatcaaacttgccaacagcagcagttaggggtagaaatatgttctttaagggaaaaaacagacaaaagttatcaaatagtattagtccttaaagaaacaataaaaaacacaaataattgtcaataatacaacttttttttttttttttgagacaaggtcctgctctatcacccagactggagtgtagtggtgtgatcttggctcactgcaacctctgcctcccaggctcaagcgatcctcccaccttagcctccagagtacctgggaccacaggcatgtgccaccatgcctggctaattttgtaactttttgtagaggaggtcttattatattgcccaggctggtctccagtgatcctcccgcctcagcctcctgagtagctgggactgtgggtgcatgccaccatgcctggctaattttttaactttttgcagaaaggaggtctcactatattgtccaggctggtctcaagtgatcctcccgccttggcctcccaaagtgctgggattacaggcataagccacaacacccaggccaatacgtctttatatttcaattatttaaaacagcctaaggacaatacttgcatcctaaatttcctcttaaaactctctggccactttgtactcaaacacaatatataaatggtacattttacaacttaattcaagactttacttatttattttggccaggtcctgttttcagcacagcgctaaagttccttttgctgggcatgctgtgccttatatatttttcaaatccaagatttttcccttgaccatgacagtagaataaaaagctcaaattcaagacagatactaatctaggacaccaacaatcgttccactgaggtgagatttttaaaaatgcaggaataaaaattctattataacattcactttatacatattcttcaatctacatgattacctaaaaagcaaatcatacatacattctttataatacatcaagaggaaatctatgagttaaaatggatatttagaaaagaaaataattacctttgatgcaaggttgtctactagagcaatcatagaattcttaaacaaggtagcagcagtcagaggtcgcttggtcacctctgtaatgctcagtttgccttcaggccacatattcttgagcacaggatttgaactgagaagcacagaaaaaacaattcaaatgtcacattcaaataagctggataaaaactgataagcaattctgctgaaatgtatcctgagaatcataattggactacagattcaactcacaaggcctaattggaatgatgattccatccagaaaattatgctacaagaataatgactgatactgcaatgcaaattgagatgtttttccaaactatagcatattttaaaaattattt

SEQ ID NO: 1558 - DNA, 2641 bp, Homo sapiens
catcataagatgacaatttgatgaattttcaccaactgaaaacaacgagctaattagcatccacgttgaaaaccagcacatcgctgccactccagtagctttcttctacatgttattctgaccatgtttatgcttaatccagtttagggataaggctaccaaaagcatgtagtctgcctttgaaataatatcatggcaattttagagtcaactgttaacttggttatgtcagtatttcactgctggaagactgatttcagaaatactttgctcccaaaaaacacatctttaagcaaaaatctgaattgcccataacaataattttctccttttggtacatcagcagaatctgtcaaatggaagggtgaattgatgagatgtagaggatatggatctttattaagcagcaatgagtgagcaaagaagcaaaatattaaatagcaaaaaacaacaaacaaacaaaacaaaaaaagaagtggagactgtaccttactatttaattcaggatactaaatacatactttgcaagtgatggttatttgctaatagctttttaaggtgttttactttgtaaagattattatagaagaaactgttcttcttacttcattttatacaaataataatgtcagtagtatttagtcagtggcccctattttttttttttttttttttttgagacagagtcttgctctgtcagccaggctggagtgcagtggtgcaatctcggctcactgcaacctctgcctcctgggctcaagcaattcccctgcctcagcctcccgagtagctgggactacaggcatgtgccaccatgcccggctaatttattgtatttttagtagagacggggtctcaccgtgttggccaggctggtctcaaactcctgacctcaggtaatccacccacctcggcctcccaaagtgctgggattacaggcgtgagccaccgcacccgaccaactggccctatatttttatagaacatttatatatttgtttttgttattctaacttgtttctgttttattagaatatcagtgcagatctgacatctatcaatctacataaatatatatatataattcaatccaataaacatatgtatatttatgtaaatggatcttgagatgggagtagggcatgtgaatttggaaatagtgttttaaaacatcagtgggtagctattttatagttacttgttttatagtttttatagttacttgtttttctgaggtaggatagaagaagcagttgaggactggaataggaaggaaaaggctggggagggaaagttgtagaaaaaagataggaagctgagaggtcatgggagctgcttttgctgaagttgttcatcaaaccaggggccagatggccaggctgaggtggaggggaccctcctccaatatccctgactcccttgcctgtgcttggcctctgctgggactgagaactgggagagtggctgccattggcttgcctgctcccaggcgattcaacactttcctgttccctttcctccaaccatacattggctcccgggaccaggccgtgtgtttatgtgtgtgttcattcagtcataactgcacaccatcgattcagatcacacatatttatcagaagtgtagccaactttgacgtttgtttggttgaatatcaccagtagccaaaaaagtctggtgaatgtcaactttaaaaaaaattgtggtaagagcatttaacatgaaatctgccctcttaaattattttttctttatttttgagacagagtctcactctgtaacccaggctggagtgcagtggcacaatctcagctcactgcaatctctgcctcccaggttcaagcgattctcatgtctcagcctcccgagtagctgggattacaggtgtgcgccaccatgcccagctaattttttttaattttgtttttatttttagtagagacagagtttcaccatgttggtcaggctggtctggaactcctgacctcaaatgatctgcccaccttggcctcccaaagtgctaggattacagatgtgagccaccacgctcaacctgccctcttaaatttttaagcataaaatacagtattgttaaccttaggcatggtgttgtgtagcagatctctagaacttactcattttgtgtaactaaatctttatatccattgaacagcaactccccattgccccttccctttagcccttggcagccactgttctactctctgcttctatgtgtttgactaatttgattctacgtagaagtgagatcatgtagtatttgtccttctgagactggcttctttcgcttaggataatgtcctccaggtttatccatgttgttacctatgactggattttcttctttaaggctgaataatattccattttatgtagttaccacatttttctttgtccattcattcaccaatggacatttaggttgtttccactttcttgttattatcagtaatgctgtggtgagcactggagtacaattatctctttgagatcttgatttcagttcttttgggtaaatacccagaactgggattgctagatcatgtaatagttctctttttaattttttgagaaagcttcatattgttttccatagtggctacccatttgtgaatgtca

SEQ ID NO: 1559 - DNA, 2142 bp, Homo sapiens
cacaactgcacatggtggagctggaatttgagaccaagtggaccactaagctacctgccaaattgagttgcagaaaccccaaaggaggcatagaacacggtttccaataaacaagagctcatgtgggcacttcctaatgacagaagctaactgtccaagagcacgactgtcttgggacaggagatcatgctgcagagcccagggaggtccgccctgcgcagagagggagtgcagacctaaagagagccacactctgtgaaaagtggaaaaacctacagattgatcccacctgttcagagcaacaggcacggcttcactcgggaccacatgtgcccaggggctccacagggctgggtcctggctctggccatctctgcacagcctctgctgggccactctgtgagaggtcacgctggcagcaagatctcagcctctgctcctttccctagtacagtttgatctctgaattcactttgatcttttaccagttcggcttcacctcttgcaccaaagctgtgatttctcagggcaagttgtcagctttcccgtatgcagtgtttttctaggtggattgtttctgatgtggtttcctctgatgcaggtgagggaagtatcatcttgactcctccaccaataaaattattctcacagggctttactaaacatgagacttgggagggacccaagagcttgcttggctgcagattcaagggtccaggactcagaaaaaagtggtctgaggccgtctagaaataggcacagatacttccaggatgcatgtaacaataccaagttctctgagcagtagctactgcctgccaaataatcctccttgagaaatactgatcaatcttgctttattccagaaagaatttaagactgcttatagaaaatacgagggagcatagtttaaaaagtgtgaagtcctcctccaaaacatgtgctaaccactaatatcaacattaaggatagcccgggcgcggtggctcacgcctgtaatcccagcactttgggaggccgaggcgggcggatcacgaggtcaggagatcgagaccatcctaacacggtgaaaccctgcctctactaaaaaatacaaaaaatcagccgggcgtggtggcaggcgcctgtagtcccagctactcgggaggctgaggcgggagaatggcatgaaccccggaggcggagcttgcagtgagccaagattgtgccactgcactccagcctgggtgacagagcaagactgtctcaaaaaaaaaaaccaaaaaacaaaaacattaaggattttggccgggcacggtggctcatgcctgtaatcccagcacttggggaggctgaggctggtgttcaagaccagcctgaccaacatggtgaaaccccatctccactaaaaatacgaaaaatagctgagcgtggtggcgcatgtctgtaatcctagctacctgggaggctgaggaagaagaatcacttgaacctgggaggcagaggttgcagtgagccaagattgcgccaatgcactccagcctgggcaacagggtgactctgtctcaaaacaagccaacaaaaaaataataaggattcttcagatatctgagtccaggtcctcatgtccactgtgtctaactcaacttattactgtgcagactgaggcaatccagccctaaaaatcctctcctctcaagctcctggacgggactctagtgagggcagaactgctgggctggtaattcctcttggtggagacaaaggaacatgggactacgggcaataagttacttatcagtcttcactagaggttgtttctctcaactaaagttatcaaaattgggtgttgtaatttttaacttgatattcccagacaagtgccaggagagaagctgttgcaaatgctgagtggagaggagaaagcctcagcagagaggcgagctggagggagggatggatgctatccttctctggactgaagcagttacaggatggctgcacagagtactcctggcaggcagaagggggcgtggggacccagacacttaagatgcatgggtttggggtacccattccaggcctcatgtccgctgtatccaactcaatttcctcttaattactgtggagactgaggcagcccgaccctaacagtcccctcct

SEQ ID NO: 1560 - DNA, 2742 bp, Homo sapiens
caccaagtgtgatgaaacttgtgggggattgacgatgagtcattcttcagactctctgggactcttgttctttccccaaattagtttaacatctgctttggaatcaaaagggtaactgcttttctctttctggctaattaaacaaatgcaaatgtatgcatagccttattgtatcctcacacagcctgggagggaagcacagtgtgggtggcaggtacatgacgctagaagcagagggtgtttagtgctggggtgggaggacagcaggaggatctgtcccagcgccagacgtcttccatccctacgggacctctcaaggtcatgctacatgaccttcggcatatgaattcacctggcaccacagtattgttcttaaaactgaaaatgtaccagcgtattgtaacttgtaagcccacaaacttcttgtttctagccatgtacttacagaaagcccttgcctttatgttttcacagggagggcatgatgaaccttgtcttatagctcatgagaaggccaacttcactaaccactccttgccgggtgtggtatgtttccctctgtaattacttctccctgtgtactttcttatggtaaaatgtcatgcttcagaacaaaattaaaaagtcatctaaagagatggtttggttatcatggaagtcaagttcctcttagtagaaatgagcagttatagtcagactttatagatactagaaagaagagcaatgtatttctaaactacatgcttgtgtcaaatttcagattttgtttaacaatttgtatattaatcatgatctaacccacctgttttggaagaaccctctcaaactgggtttttcctctgctctcacaccacaacaacagtcatcaacacggaaaaagacttctgtgaccaaatgtatgggggtttctctatagaagtagtggacaccagctaggtgttctccagttcaactctgacgctgtctacctggagagagcatcagatcccacagggcaaaactcaggccccaaggctgcctccttctccagtcaccagtctcaagtctgggcctctggaacttctgaccaactggcttcaagttggggttcccatgactcctctgggttcaactaatttgctggagcagctcacaaaactcagggcaacactaacttacattgatcagtttattataaaggatatcgcaaaggatacagatgaagagaagtgtaggacaaaggatggggaagggcatagagcttccacgccttccctgggtgcactaccctccagaaacttccaggtgttcagctgtccagacgctctctgaactgtgaccttttgggtttttatggaggcttcattgcataggcaccacaaccatgtagaaatgtgattggacaaaaagtacatgatctaaacctagcatgcctgtctcttcaagacttttcttggtctctctgtgtaacattccttcctttagggtatagttaggactctctctagtttgagggactcctgacccataattagagaagggtcctgtcttgggcacgtgaaaggacaggagaagttcagagagagagagagattctgtttcctgaggcctaaagtgccctgaaattataagaaggactataggcatcaggagccaggaaccggttctaatgcccatagtccttgttataatttgttatctatatctatctatctatatgtatatctatatctgtatctatatctatctatcagtcaatcataacaacataccatcagataaacaatttctatccatacccattttctgataataaaaactggatctgttgctggctaggtgaaactcggaaactcatgaagctttttaccttttttacaaatgggagtgtgccctttcatcctgaatcattagagtctcctaggtacccctctctgaggactcttattctaacagcctttgcaaaaattagccaaacatctgtttgaaactcactcagagtcattttcatctttgcctttctcctagttatttttagggttgataaatttgttttccaagagcaaacagagcatttttaagctttgatttttggctagcatttaggaattcttgttctgtgcagagctggctggatgcccacttaggaacttagcctgcacggagattccttcagtggaagagcattggtctggagtcatccatccggctcctggagcttggctaccctgatacttcccggtctccctgcaaatgaacacctcagcatgccattatagttggtcatcttactctgtttttacagaatccaggaggagagttcctgcaaaggatgtcttgggcagggtttaattatttctacgaataagaaagctttcctcaggtggaattgtatttactttctgcaatataagccatgaatttacaaatagagtctgatactgtcaggatacataattgttgttatgcttaagtagttttttttttcttgagatagagttttgcccaggctggaatgcagtggcacagtcactgctcactgtaccttcaacctcctgggctcaagcagttctcccatctcagcctcccaagtagctgggtctataggtgccataccaccacacctggctaatcaaattttttttttttttttttttggtagagataagggcttttatgttgcccaggcgggtcttgaactcttggatgcaagtaatcttcccgccttggcctgccaaagtgctgagattctaggtgtgagcc

SEQ ID NO: 1561 - DNA, 3699 bp, Homo sapiens
actcgcaactttgagaatcaaatggggtgaataaaggtgtttacagggtgtatttattttaatgaaaaatgacagtttttttgagtccaacgtaggacaatgtgtatttttagaatccagattaacctgttttattcacaggaagtatgttagtgcaaatgactgtttagccactaaaatgttaataactggatcgtttgttttgtttttgagacagggtctcgctctgttgcccaggctagagtgtactggcgtgatcatagctcactgcagcctcagactcctggacttgagaaatcctcctgccttagcctcctgcatatctgggactccaggtatgtgccatcgcacctggttaattaaatttttttttttttttgtaaagagtgtctctttatgttgcccaggttggtgttgaaatcctggcctcaagcaatccttccaccttagcctcttaaagtgctgggattacaggcatgagctactgtgcccggccttttctcatatgtaaggaaactgatggtcagggagcttaggccacaggatatatggttagcaagtggcaaagtcagaacgctaaacatgcgtctttggtttccaattccagctctgtctcttagatcacactgcttctcaagatgcagcggcagctactgcaagagtgagaggcagtctgggtccagggttggatgtgtacagggccctcaggttgtacaatctctctggttgctaggagtctccgataattagagcccccaggttgctaggcaacccaagttgctaagagtttcagtttattacaggtattgggttgttaaaagccccaggttattcagattttcaatttattaacagcttcatgtttctcaaaggccccaagttattagagacatcagtttctaggggccctaggctcttatggatctaggctatcgaagttgttaggttgttagctcaacctggttgctaggactttcaggttttagaggctctgggtttctagaggcctttagcttgtgaaggtgtcaatccacaaaaagcctcattttttagcacctgtagcttttcacaggttccaggttgctacggacacagtctcagagttttaggttttcccagagttgtgggtcagcccagcagttttcttccacccattcagcctctatgtggtcagataccataaatgcagctgtatgtttctctcaggtgtttcatcattgctgaccttgttcagcacccacagcagcactgacctaattcactctactcaaggccctaagcacttaggcactggtggaaaggtcttcagagcagaaacttgttatattctaaaacaaccatgtttttttttctttttctttttctttttctttttgtttttaaacatcaactcaaaccagattaaaacagccacatgttcagccaaaaaacacatgaaaaagtgctcatcatcactggccatcagagaaatgcaaatcaaaaccacaatgagataccatctcacaccagttagaatagcaatcattaaaaagtcaggaaacaacaggtgctggagaggatgtggagaaataggaacacttttacacagttggtgggactgtaaactagttcaaccattgtggaagtcagtgtggcgattcctcagggatctagaactggaaataccgtttgacccagccatcccattactgggtatatacccaaaggactataaatcatgctgctataaagacacatgcacacgtatgtttattgcggcattattcacaatagcaaagacttggaaccaacccaaatgtccaacaatgatagattggattaagaaaatatggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacagaaaggggaatatcacactctggggactgtggtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtgtaataaaaaaattaagtaattaaaaaataaataaataaaacagccgcatgttgaagcacacttgggttatgtttctgttgtaatcattcaccttctaaccaattttaaataatattaaattagactttgacagccccttacttccaattattttattagattagccggaacagtaaaactagagtttgtgtgtgtttttcatttctaagaaagtttttcttttccttttttttttttttttttagacggagtcttgctctgtctgtcgcccaggctagagtgcaatggcgccatcttggctcactgcaacctctgcctcctggttcaagtgattctcctgtctcagcctcccgagtagctgggattacaggcatgcgccatcatgcttggctaatttttgtatttttagtggacatagggtttcgctatgttggccaggctggccttgaactcctgacctcaagtgatccgcctgctttggcctcccaaagtgctgggattacaggtgtgagccacagtgcccggccaactttttttttcaaagtaactataggttcacaagaagttgtgaaaatagcactgggagatcctgcatatgcttcatccaatttccttcaatggttacgtcttacacagctatagtgtaataccactgtcaggacattgacattgctacaatgtgtatatagttctatgccattttataacatgtgtagatgtgtgtgtgtgtgtgtgtgtgtgtgtgtgtatgtgtttgagacggagtctttctccatcgcccatgctggagtgcagcggtgggatctctgcctcccaggttcaagtgattactcccacctcagcctcccattagcatggctaatttttatatttttagtagagatggggtttcaccatgttggccaggctggtctcgaactcctgacctcaagtgatctgcccgtctcagcctcccaaagtgctgggattaataggcgtgagccactctgcctggtctcatgtgtagatttgtatacccaccactccaatccagatacaaaactatgccatcaccatgaagctcccccttgtactacccctttacagttacattcatcttcttccgtccccaacctgtgcatttttaaatgtatttgcttaacgtctcttcagtgccttctgtgtgcctcacccattaataggtcaaagaaatacggagataactataatgtacttgtagctctggaagagctcacagacagggccatagtcacatacatcacaaactatagtgtaatgtggtaattctatgataggaataagctcaaggtgcagcggcaagcaaataggtgagggggtggggtgttcaggaggcagagagtgttggattagctccttctgcaaaagttgtgacactgggttgattttgaaggataagacaaagttatctgttgccaaatgaggaagaacgtttagacagacatgtctggggaagagttggttgtttggaacttccagggcccaggggttg

SEQ ID NO: 1562 - DNA, 2099 bp, Homo sapiens
tcatggagtcctgggattgaaaagctcaaagggatgctgaaaagaccctgtgataagcagaataatggcccccaaaggtgtccacatccccacctccagaaactgtgactaggttgccttacatggcaaaagggacattgcaggtgtgattgagttaaagttcttgagacggagagactaccctaaattatgcaagtaggacccaatgtaatcacagaggttcctatgaaagggaggcaggaggatcaaggtcagagagagaatggaaaaatgctatgcttctagctttgaagacagaggaaggagccatgagcccagggatgcaggtagcttctagaagcaggaaaaggcaggggaatgaattttcccctagagctgccaaaaggaacacagccctgccaacaaccttgattttattgagcctagggaaatccattttggacttctgacctccagaattttaagataacgaatttgtgttgttttcagccactaaatttgtggtaatctcttgcagcagcaatgggaaacaaattcaggtcagtttgccaggtcaactccttgcctcagttgccaaatctatagaatgagattataacataagtcaaactcctttattttattgattaacttttcttctgggtcatgaactgaaggtggggatatcaggaggaggaaaacatgatgcagcagtagaaataaaaatgcagggctttcttgtatgccaaggtgtttgccccttggggctgcaatggccaagtagaagagaaacttccctcattttttcctttggcagaagaaatggcccttggcagtgggaggttgggggcggtacagagccatcatcctaaatgtttagtgctcacaatcagtggaaaatgaacttatgggactgtataagcctttaccagatccccctctctgtcttgtcttctccaaacagtctacagaatgagctctccaaatgtaaactgtataactccctcccatgtttccaaggaccccaggctccttacccaccccttccctagccttgttctgagtagcctctgcctcgaggcaccatgcggggctgcctggattgggcatcactggtacccactctgcacaaatgcatctccttctgcccagaatgtctttctaccttgtccacctgaccatcttcccacttgtcactgaagattcagctctccatccccacccaaagcaactctttctcttgctctgttgtatcttccacatctgcctgctggagcccctgccatagcacatcgtgatgaggctttaactgtttcctccagcaggctggagtatcctgaggccaagttctgggctgtctctctggacctcaaaggtcctgcacatggctaggcatacaccaggcactcaggagatgcctaatgaatgaataaatgggagatttatgggtcaagcctcaatcatttatgaatggacaaggccaacctggaggccaaatcaaggaatgttctcaaagaaaaaaatggagagagaatggataaatgcaggaaggagagaagataatgatggggttgggggtcagggatggagagggggaggacatgtcagcactcaggctgtggcttggggagggtttggggacaaactaaagctggcacagaagagagtcactgggaaggaagggctgggtccagccacgggaaaggcatgacccatggaaagtgtgggggctattgactgaggtaggtgcaggggtctggagcagggcaagaattccaaggccaggggctacgtggaaagaaagggctagcaggcagacaggaccccagggaagggtaggcagggctttcatcatttagacaaggagaccctcagccaggaatccttttggatatggttcatggagtgggagagaatccaggcaatctacaaacacatcccacttccctccagtacagtcattgttctgtggtttctgtacagcatcaccctgtccaaactcctatccatatgctcctggaagcctgtggctttgtgtcaatctctcctattgatggtgaattcctcaagagagaccatattttattcagtccagggctccatcacctaacccagggcct

SEQ ID NO: 1563 - DNA, 1772 bp, Homo sapiens
caaaagctgataaactacaaggaaaaatagacaaatctacagttatagttggggacacccctttctcaacaatgtttataacacataggcagaaaatcagtgaggatatagaagacttggataataatggtgaaagggtgaatgatcttcccctacgatcaaggcaaggcaaggatgagacaaagtgtctgctctcaccacatgtattcagcattgtagcaaaggtcctaactagtgcagtaagacaagaaaaacaaacagaaggcatataaattggaaaggaggaagtaaaactgacttttttcacagataaaataatcatctacataaaaaatcctaaagaatttatttaaaagttaccaaaactaataaatgtgtttagtaaggctgaataatatgcaattgaaatacaaaaatcaattgtttcaatatagtataatgggttcactatataaacggttggaaattaaaataaaaaaccatttacaatagtattatattaaaactatgaaacagggatacattttgacaaaatatttgtagagtcatacactaaaaactacaaaacattgctgagagaaattaaagatcacatatgtaaatacagagaaatgccatgctattgacaggaagattaaatattgttacatcaattcttaccaaattgatttatagattaaatgaaacccaatgaaaatctcagcaggatttttaaaaaatagaaattgacaagctactactaaaaattatatggaaatgtgaaagacctagaatagtcaattttgaaaaagaacaatgttgacggacttacactgtctaagaaacttagtgtaaactataataaccaagactttgtggtattattataaatatagacatatagatcaatggaacagaaagtccagaagttgatctacatgaataacatcagaagtcattaaggaaatgcaaattaaaaccacaatgagatgccactacactaagcaccattataatggctaaaatgataaagactgaccatcccaagggtcagggaagatgcagagcatttagaacttttgcacatgctgccagggatgtaaaatggaacagtcactttggaaaacagtttggcaatgtctttaaaagttaagtgcatacgtaccaaagaacctacccattccacttgttaagtatttacccaagggaaagaaagcataaattcatgcaaaggcttgtacatggatgtttatagcagctttatttgtaggagccccgaactggaaacaacccatgtttccatcaacagcctaaaagatttttttaaaatggtatacctacacaatagaaatatgtctcagcaataaaaaggaataaacaactgacacatacaacaacatggagaggtctaaaaatcattatcctcagttaaagaagtcagacaagaaagagacaacattgtataattccattcatataacattctagaaattgccagctaatctacactgacagagacggatcagtagtttccttggtgtggagatggaaggaagaattaattacaaagggacatggggaacctttgttgggtggggggtaatggaatttttttctttttgggttgtgttgatgggttcacaggtatatgtatttgtcacaactcatcagattaaacactttaaatatgtgcatatcattgtatggtgatcatacctcaatacagccataaaatgttaaaagaagaagaagaagggatagaaggaggaggaggaggagaaagagagggagga

SEQ ID NO: 1564 - DNA, 2288 bp, Homo sapiens
aatttggtgagggtacgggaggaagaattcagggtgccaccccagttttctagcttaagcaggtgagcagaggaaagtacaattttcggaatctacttgttgggatgagtgggtgggtgtggggagaaaagtctcaggccagagcctcttagaaatagggaaagggagctattcactaatcaattctcatatatttgaggttcacctgaaaggtctaagtgttgacaactcttagaacagatcttctccatctgtgcaattgcaataataaacttaccttgttagatgattacaagggttaaattaattaatattgggaaaacttttagaacaatgcctgacatatgtaggcttaatataagtgctaaacataataaactctgatggctgcttcagtaggaaggcaggagctagagagataagacctttgccttgcaaactgtcctgaatgcgctttgcttgtgcccaccccaccccctgagatgctggcatgaagctgggcatcttggcttcagccaaatcagagtgggttttccttttgtgcaagatgtgagatgccatgatcaagcacagagtgactgtcccctcctcctctcccttcctcctgcatgggcactgagcatccagctataggctctcccggatagatgccagattccttctagttcctgtgccctaggaggatggaggagttcagaagctgaatgaggctggggcactcagagagggtggacatcacagggcggagggagaatcagactgcagcaagttaacaccttgaagtcattaaaagccctctacaaatggaaagtattttgggcagcacttgaagaaataacacacataaagctaactacctgcggcaaggcagcagaggcactgccacaccctccagcttctctccacagtgtcaaccccacctccttctccctgctcatcttcactttctgactttcccagtttccaggatggacaatgagtggagaaggtcctggcgggcagggagcggctaggaaggaaggaggggtgtgtgtgatgcttttctccaagcatatacccttgtcttgctcaggatctggagagaggaccctcccaccctctccattctagtctaaaggtgtcttctctcagggcagcctccttagtaaggtggggacctttgtgtcctcagagtcctcagaaggggactttgccacctgaattacgggaggaggagggatgacagctaccggaaagagggaggctgatgaattatgtatggctggaggtgatagtaaacagtctctggatgatgagctggcggcagacaggcagcactgggcgctgagtcatggcaaagggggtaattagtctgtcagctgtacacacctctgggtggggtgaggttttgggctgagtcacactctgcagagggagagagagagagcttggacctcagaaaaacaaggagggggctcatgttcttgatgagccatgctgttcttgagatccctctctcctcccacttgcaggctcaggcccctccgccaccctaccctagagtcaccatcccatctcccttgcaagtgactcgcctggaccagccagatatcagccaggagggcattaggacttccctcccctcagcagagagggggtgtaaatagtcttctgttgcttcctgtgtttgaggtccccctttaagcccagcctgagaatcttggagctgagcctgaagcaaggagtggggatgacagaccttacgccacagaacatcgggccacagaagcccaagatagagggaagccaagaccctacacacagcctgaaccaagtgtcagtctgaggggtcaggcaggaagatgagcaaagagatggagacaccaagatggatagatggattggctcaatcattcagtcattcaacccgtatgtggtttctgaggactgttatgagccaggtattccttcagattctagtgatacagagctcgacaagagagctcagacacctattctcatggaactgttagagtcagcagatattattagctagacctgagcagcaggggcagcccttgagaaaagggaggtctggagaatctcacaccccagagatcacctgaaacctgcaagctaggtatgagcagaggaggggaaatacctatgctggaaggaacaccccttaagacccccagtaatcgctcacccagcagttcacctgtcagtttgtcgctagctacatgctgataaggaggagacgagggcaaaggagaaattccttagagatacagaggcacattaagtat

SEQ ID NO: 1565 - DNA, 2298 bp, Homo sapiens
ccagcagtattcctgtcctgataaaattaactgccctcccccatcttgtcccatgacaagctccagtgacaaagctccaaggcagctagtttttaagctccaagagggcagggatcatgcatttgagccaatatctactggagctattcacctggagagccaaagggagtccaggaatgcgggaataatgcagggattggaatgtcagtgctgtggggagttgatgatttcccatggagtggaaaaaagtgggctcaatcacttaacagtaccagtccatagtatatgctcagttaatatttgctgaataaatggaaatagaataggaaactgaggctaacacataattggactcattattgttaaaaatagaagtccccctgatggatgagcagagttttccagaatactgctggccaatttcacccagatcgccatcccagcatcctcttgctgcaaatgctttttataacaacacattataaactatgtagttgctttggcaaaagtggctcaaagtgagagaactctcaaaagacagagacagctgaaaatgaaaacagaaggtttttaggccactgcccctcccagcagaatcctcggtcatatatgggattttgtgtctcctttacttaacagccactcagtccccaaagccccatttcagagactttggggagccaagttcacctctgaacttctgggctagtcattttcttgctcctctccttaaatctttttcctgacctgccctccccaacttctatctgtgcactaagaagatgcttaatgaatatggcagaataaaaactcttggctgtctcatttcactcaagccaaagtgcttgacccacaggaaaatgcttaactggatggattttttttttttaaagaacaatctccttgaaagggtaaaggacctaagagtgagtgctataatcccagcttttgtaataccactcaatggaggtctctgaattccagtaaagagcagtgaaattttattatcacaaaaaaggagaaaaatgtttcaattagaaaaagattctcaattgtgctactttaaaagaaaataacttcatatcaaacatatttaaaataaaaaaataaaaatgggtctaaacgagtagaggagcatattattcaaagtacttgggatcgagattcaaaggactttggttcaagttcctgtgctggcacttactggctctgttatctttgtttctttgtacctctgcattttcatctgtaaaacgggactacggttatggccttctgtaacaccatagggacacagtgagaatgaaatgaaacaggaaaggttaactcatttcactccttgagaagttatgcgaagagaagaggagtcttagtgtcacccacatggaattgcccaccttggaagactctccagaccttgttactgtgggtgcctaggatacctggtcacttggtgcatgatgtggttacaaaacaagacttcgaagatccctttgaaaccacaatatctacgattgagcaaatgttttaaaaataactctaacaaaacaaacttgagtaatttatatttttgagctccttttctactaaccatttaccagggaccaccacttgattgtactatctccatttaatctgtccaacaactctgtgaggagtataattactgtcctcattttataaataaggaaaataaatcacataaaagttaagaagcctccctcacccacacagagctcagagtccagcagtcatctagaatttgaaccaagtctgcttctcatgctcagttggatggaaaggaagtagagcaagtccagtccagcctcacaagtggactgtggtatctaaaggacagatgatatccatgggcttctgcagaactgattctactgattctccatgcatccagctgagaacttcagcttccctcgaaatgttcctgtcacccaggaacccgtgcattacggatggaatctgagtttggcacgcgttcaggttacttttgctttcctgagcctgggagcagagctctctgttatttctaagctcacaaaagtccaggaatgtgtgctttgccacagcaaacaccaaagtgtctaaacaattacaataggtaatagaaagctactagtgaggccaaggcctcacatttcttaattattttctttttttctccacagtatgatatgctgcatgtgctgaataaaagtctgatgaggtggtggagccaagatggccgaataggagctccagtctacagctcccagcgtgagcaacgcagaagatgggtgattt

SEQ ID NO: 1566 - DNA, 3190 bp, Homo sapiens
tctccaccttttatcccccagacctcctgccccatggttcaccagaagaaagggcatgtagaggacaatcaggagggctgaatcaatccttctccttcaatgcccctctttagtcagaggctgcagagaccatggggagacgaagatgatcacaacccagcccagcccccaggactcaccccccatcccatgtgacattggacaaacccctttccctccccgtctgttaagcaagagagaagaacccggatcttaacttggggaggggacatggaccccttacacaccatccaggggagtggttgatgcaatgactgcttcctgaccatggattccccttaaagctccatggaggccacttttagatgccttttctagtttctgcatcccccaaacaggccaagaaaaagcagtccctccctgtcccgtggcagccagctccggaataggctaggggagggggcgtttcacctctcatccctcacgtggggttagtggagccggcagggccatcactcactgcgccaatctcttgctccagcgccggcccaaccccatcccctcctccagagatttgtcctccagcgaggacagctcatctctctcacccccagctctcagcaggcgtggctgggtgagagcctgggaaggaccctggagaccaccctccaacttggcattctgcctgggtcctcctgccctcagcatctcttcaatactcagcccctccctccggccctctcctcccatcccactttcagccaaggaacattttaaatgaattcaatttaaaacttcagaagcaatcccttcccacatctttaaagttcacggccccagcatcagactcatttgttcgagatttcattcaacaaggagctcagtctgtcacctctttgctgaagcatccaagctgaattgtggcactctgcttggaagtcctagaataagcacttccttgagcaccctgtcttcagggtgagggcctgagctctggcatctctgcctctcccactgggctgtgaaccactcgagagcacacaccctctggattcattttctaactctctacctgtgcctggcatacagtatgtgccatggatggctgactgcctctgctgattggggatccactatgtgcccagcatcgtgtaggcccaaagggctggccaagaacaatgcatctagtggaggtgacaggtgcagaaaccaacaaaatgccgctctgaccatcagcacaacaaggtgagcagcccccacccacatgctgtgctctttatccacttacccacaactccagccacattggccacaccctctagagctgaatcaggccccccaggcagatgaggagtccagctctcctacattccaccactatcatcactaccactctccagaacattggggccagaagagagagcttagtgcaagctctgcaccttgagaggagagtaggaaattctctctggctgttcttataaaggatggggaaggcctggcaaaaaggggaagcaaagagaaccattctctcactctgccccgaccactggcttactttggttagagaatattatcgcaaatgccatggggacagcaaactcactacagaaaacagctgtagccctcagaatgcatttggaggagctgctttgggagatcttcccagctccctgggtctcctcctttagagagcttgcaactacagcagaagtctagacagactccccattgtacattcggtctcagttcaagggggttcaaggaggagaactcttcagatctaggcaaaaggggcccctgcccggagttaacaaactttctcaaaggaccagaaataaatattttaggcttgcaggccatccaggccctgttaaaattactctgcccttgtacctcaaaagcagccttaggcaatatctggacaaatgggtctggatatgctccaatacgactttctaaaaacaggcagctgtctgctggaactcacacacaccacacaaacacacccttaaagaacatggggtgcctcctgtcactcagaattattatgttcagcactgtcatgatgcagcctataatcctaaacatctactttcatgattaacactgttcaggccccgggaaatgtttttccacatcttttgctctaggttctcaaaagaaaagacaacagagtcagaatgctgtgaagatttctgggatctgctgctggtgacatcaggctccacttcagaatgttgagagggtatgcgcagcagaagctcttagataagaaaggagataattaattagcttttcaaatccttgctctttgacagcatgaatgcaatagattgttgaaaaggtatcgtttccaagtaatgccaagtgtccattctctagctgtcttcctgttccaatgcatggttctggaagaactcatgagttgtcaaattattatttgtagcatttactatggttgacatggcagctgagaaacatttttctacattagcaattcgtatgaatcatatggtacatacgtaggtctacacgtaaaaagtacgatgctgattgattacatttaaaaatggcacatttcatgttacagttgtgaacagttttatctttataaaatatttaataatagttaagtatgttttccaaaaaattaaatacaattttagctgtactcaaatggtttttgtttaatttttttatattcattaatcatgatgtgaattacacctttcaattttataggtgattttgaatacttttttgaaagtatatgtgagataagtataatgtttcaattttgtactatacttgaacttaaatgtttaagaaaaataccttcaaattttggacactgaataagattgcattttattttctaatcctttacctgggttgtccaatacagtatctgctgtttacaaatggctattcagcactggacatgttgcctggcatactgagatgagctgtaagagtaaaatacacaccaaatcccggagacctagcatgaaaaaaggaacataaaatatctcattaatagtttttaaatattgattccctgttgaaataataacattttgggcatattggactgaatacaatatattattaaaattaatttcacctgtttctttttatttttttatgtgagtcacaactagccacatttcaggcttgcaggccatcc

SEQ ID NO: 1567 - DNA, 4249 bp, Homo sapiens
ctggggcttgggatcctgctgttggcctgactgcagcctgacaacttcattgctctaaagaaactgacttacctacacagaaccccctaagcattcagacccctaatttttatgtagatctacagaactggtacatagaaacctaaggggttacacttgttttatacagcttcgtcctggtacatgaacaagaatagcgcccagtatcacattggtgtcttttttttttttagacggggtcttgctcttgttgtccaggctggagtgctgtggtgtgatctcagctcaatgcaacctccacctctggggttcaagcaattctcctgcctcagcctcctgagtagctgggattacaggtgcctgccaccacacctggctaatttttgtacttttagtagagacggagtcccgccatgttggccaggttgatcttgaactcctaacctcaggtgatctgcccaccttggcctcccaaagtgctgggattataggcatgatggtgtcttttctaagaagctcgaacttgtacaagcctctgtggggccagcaatgcgaaagaacagcagatggatccccttcgtgccaccctcactttaggtgacgctggaagaatctgagctgccaaaatcagagttcaggtccccttttctcccccaacctaccagagaggactcaaacttgagatgtgcagagtaaggtgcaggcagaaactgtagccaaggcctcagggacggggatgagcactcactctgcttctccttggtgctggccctggtctcctgggcacaaatctacttggacagaaataatcagccaaattaatttagctttaaatagcagcactgagaatgtttccacaaaattttctccgaggagagctaagcagaattaatgatggcacaatatcagagagaaatgttatttattaaggcctaatcattccagggaggggggaagtcatcacacaaaataaagtggaaatcagccagctcagtccagccctgctcagcccagcagccaaggaggggccctgggaggctgtgaccaggggagcctcgtagtctggtttcctgcaaagccaacagcgcctgctggggtctccttggtacttgagggctgggcttccctgttccaaccacattcctcgcggctgtgtccacaccagctcatttgttccatgctgatcccctctaaagggaaacagcctcaactgcacaagacaccctcaaggaataaagttccctaagagaagaaattgtcccacccctccgcacttcctgctgccccctccttaaaagttcctttgttcatttgttctttcaactaatatttagtggccaggtacggtggctcacgcctgtaatcccagcactttgggaggccaaggcaggtggatcatttgaggtcaggattttgagaccagcctggccaacatggtgagacaccatctttactaaaaatacaaaaattagccaggtatggtggcttgcacctgtagtcccagctacttgagagactgaggcaggagaatcacttgagccgggtggcggaggttgcagtgagccgagatagtgccactgcactccagcctgggcatcagagtgagaatccatctcaaaaaataaaaatagtgagtgcctacacctaagagccaagccctgttgtgggtgctggggatgcaacaatggaggacaggcaaacaagtaaatgaacaagatgatgtctgtatcaacagtgtgatgaacacaataaagggacgagagcaatgggagagggtggggatttagatggcctgatcagggaaggccacggggaggagacaatatgtgagccgagatgtcaagaaggagaaggagttggttctgtgaaggtctgagtaggggcagaacacccagggagagggcacagcaatggcaaaggcctggaagaggaaagaaggccagaggagcttcggcccagtgggccagggagatcatggcagaggctggatttgttctcttcagagcagtaattatattacaaagagggcagggactagccaaagttggagaacactcaaaagcaagatgaaatccaggggagaaagggtgaggggccacttactgggcaacccctgttcaccttgaggtcttctcccatgatgctatggccaccaacgtggccacagatgtgacactgtgtgtgttactgtgaggactgtttggtccctacctaaaggggttgctgtctactagaaagggcaagacattggttccattcacgagacatttattaagcaactactatgtttcagttgccattttccttaagacattgacacagtaaaataggtctgaagggaactggctcccatctgctgggggcgcactgtataggggcaggcaggggctctgggtctgtcgtccaaaatgcaggttctgcagtcatagagtcctgggtttaaattcttactaattaactatatttcatgctggacccctcttaacttcaatagagatggcaccaggttcaagaggccaaagaaaagacccagagccagcaaacaaggcacagttgtgtttttgttgttgttgttgtttttgtttcttgttttttgttgctgttgttgttgttttttgagatggagtcttgctctgtcgcccaggctggagtgcagtggcgcaatctcagctcactgcaagttccgcctcccaggttcatgccattctcctgcctcagcctcctgagtagctgggactacaggcgcctgccaccatgcccggctaattttttgtatttttagtacagatggtgtttcaccgtgttagccaggatggtctctatctcctgacctcgtgatctgcccacctcggcctcccaaagtgctgggattataggggtgagccaccgtgcccggccaatacacggttttattagcaggaaacttacatacagagcagcccagtggtggcaggctgggcaggagaactatagccacttacaaggagcaggcagtttatacagcattttcatttagcattctcctcctggcaatctctatcaggcaacctatatttaacccaaaacaaagcaccttgatcccccatacaaaccacatttcaaaggacaggctggaggttcagatgttcctcatagataagaaatgaaactctaagttggccattcctgggttccttagctcggaacacagtcagatgcatctgccatacaggtcattctcggggtatgcttaagttactgctgtcaggtgcatctgccatataccatacaactgtaggtaagatgtagaactcctctgagcttcagtttcttatgctgtgaaataggtactactacctaccttgcagaattatttggagtattaagtggatgaggatggtcctgtggtacctcataaactctccaggatcacagaggttgccctcagtcagaatcacaagccatcaatggcttgggtctggagtatgtgaggaagagtagaccagaccttggatatgttatatcagtgggtacaggactcagtacccatcctgctacaggaaacaggactcagtttcttctctataaagtaagaatggcaagccttccttcagatgggtgcttaggatcacatgagatgctacttgggaaacacctggtccaggtaactcaattactgccaccctcccactctgtattagtctgcttaggctgtcataataaaataccacagaccaggtgtcttaaacaacagaaatttaccttttacagttatggaggctggaagtccaaaatcagcatgccgacatggtagggttgtggtgaggactctcttcctggcttgcagaggccgccttctcactgtgtgcttacaaggctgtgcacactcatggagaaggtgaggagggagaggaggaggagggcgaggagggagaaggagatgagggagagggaaaggaggaacagggagagggacaggagggagaaggagagggaaaggagggagagggaaaggagggagagggagaggagggagaggaggaaaagcaggagaggaagaagagagtcagggaggagagggagaggaggagagggagaaggggaggagggagagagggaggtgggaagggggagggagatgagggagagggagaagagggagagggcgttctctggtgtctcttcttataaggatactaatcctatcagattagggtgccgcccttatgacatcaggtaaccttaattacctcctaaggccctgtctcca

SEQ ID NO: 1568 - DNA, 1527 bp, Homo sapiens
gaggagatctcctacaaattacaacaaaaagaatgaaaaaaaaacaggagaaaattgattagaaattcagaaaatctgtccaggtgatccaacatctaacagaagatccagaaagagaatggaatcagagataaggcaattatcaccgaagtaacttgagaaaatgtcttagtactggaggatgtgagtttccagattagtgggcctcctgacacaaagccacttaattaggaaatttcagaacactgaggatgaagaaaagacattaaagaaaccagaaaggaaagaaaaaaatctggctcaataccaaggatcaggaagctgaatggcattaaacttctcataagcagtctcagaaatgttatctcccatgctccaccagaataaaagcaaaagccaagaaaaaaatgaaggtgtgggatccaggaaacatggtgtccaaacaggagagaagctaaggggtttcgcagggggtgctgaagaaaccccaggattgcagctacgcaggtcagtgcacgagagagtggaaggatggagggctccatgagggatgttttcaagaaaaaaaaaaaaatgaaagaccacatgatgcagttaaaaacagggggagtggatgtgcacatctgatacagcgtttgcagcctccaggctcagaagaagagctctgacatgtcttctaagagacataagatgcaaaatttcctcacctaccaccccctaaccaaaagcagtttgtagcttattgtaaatctcagctggttgctatggaaatgattatacgtatacacagaacaaataccttaggtgctcgcttctttccaaaactgggcaggggaagttactgaagtagtgcttacttgggtaagacgtgggagacattaaattaaggtttagagaagatgtttacttattttttcaggatcctccacatcagagtaaggttacctggtagagctgggagaaggctgtgcaagaagtttaggtgcaaagcttcacttctggtgaaaagagagaggcctggaatttagaatgttaaaagaatttcaaccatgaaattgcaaaaagtcctagactctgagagcaggtgggaaatgagaaattatggagtacaagcctttcactatacagaaagagctgaccaaggtcacacaacaggttagcaagacgagaacctctgccaagtgcttccagaaacttctctgtggaggtttatctctgaggtcttgggataatcaggagagtctgataggagaaaggatttgttaacccttcccctaacctgaggtcttgactcccctgctctcttaattctccaacctcccaagcccacccccaaccacccggtcccagcctgcaaggtaattataatgaagttaaaccaaattacacacgcagggtttattttgtgtttttttctgctgctgctgttgccaattatggtgcaattagactgccttcattagcaaatgagattagaattaacattgttaattactcgttctgttaaaaggggaagcgggggtggtg

SEQ ID NO: 1569 - DNA, 4371 bp, Homo sapiens
tgctagatttgtgtaagtatactctgtaatatttgcacaacaatgaaattgcctaaggatgcatttctcagaacatatccctgttagtaagtgacacatgactgtaattggaaagcagatttcagttcaggataaggaaactttaaaattcggagttgtatgaaaatggacaaggtcatctcagtgagttcccctcatgtaggaaattacacaggaccaagggtactaaaggggaggtaactgaggttggttgtaaggtatccttctaactctgagattaaatgattgtcttagtgcctcattttctcatcattgaaaaacaggaacatacccataataacagaaaagctgttactaaattgaaaaatggcacatcattagtaatagacaaatgtgtccgtctttttcaagcaaaccaaacaaattgttccctaaaattcttaattaaaaattaaaattagtttacatgttacactcattgtattttcaagctttgagcaattatcagccaggcccaaatttagcaattgcaggcaagggcaaagttaagaaactgtaagtagcaatccataggttagattctaatggtgaagaaaatcccttcagtccctgatcattgtttatctcgggatttaaacagtaactctaattgtattctttgaacacaaattcctgccccatcccccaccccatcccttggttaattagctgcataggtcttataacaaatgcccactcagaagcactgggaggtagaaatgctgttgataattaaacaccacaatagcacagagcctgtttcaggagccactgagtggtcttgcccctgctggactgcttaccacacagtcacagaccctccattgtgctggtatggctgctcagagggatagctgcttggctggagaaggaaccaactgcaatgagagaaaagaccaaaccttgcagagatcaggagtatggcctccagggaaaagtgtcctgtgggtggaagtgaaaggggaatgaatccaagaaaaagagaagtggatgggcaggaatgataaaacagacatagcctttctattttctaaatcaaaccaaccagccaaactgagttcaccaatttcataccaaatagataacaatcaggaaattgtaatatataaataataggttgatttgtattctatttggtttagagaaaatccaccgagttctttaaggtttagatgaagatcatgaataagtcatcccatctccctgggtctcaatttcttcatctttaaaataaggaagttgaaaatagccccattctgccatcagatccagaggctagtagttacacttctgtaacaccagatgttagtgacaatgagcctgatcactataaatattctgacaccactgactgatccagagaatgaaccttttgatgaagatcagcatacacaaattacaaaagtctgaaatttttttatcaagaggtataaaacaccatgaaaacaaacttgaataaactgaaaatgaactttttttttttttttttttttgagaaggagtctcgctccgtctcccaggctggagtgcagtggtgcgatcttggctcactgcaacctccgcctcccaggttcaagcaattctcctgcctcagcctcccgtgtagctgggactacaggtgccggtcaccacgcaaggctaatttttgtatttttagtagagacagggtttcaccatattggtcaggctggtctcaaactcccaacctcaggtgatccacctgcctcagcctcccaaagtgttgggattacaggtgtgagccaccgcgcccggctgaaaatggacctttttttttaatggcaataggacattgtgtcagattaccagttatagcaacaattctcttttcctgaccaatcttgttttaccctatacatccacagggttttgacacttgttgtccagttgaaaaaaggttgtgtagctgtgtcatgtatataccttgttgtgtcaaaaggacatttaaaattcaattaggattaataaaggtggcactttcccattttattccagtttcataaaaagtggagacagactgaggtgtatacataagaattttttccttttgtgttctgtcgccaactgaagtggctaaagagctttgtgatatactggttcacatcctacccctttgcacttgtggcaacagataagtttgcagttggctaagagaagttcctgaagggttttgctgcattctaatgcatgtattcgggttaggggaatggaaggaatgctcagaaaggaaatacatttattctagactctggaccatacaccatctccagctatttacgcacacctttctttagcatgctacagttattaatctggacattcaaggaattggccactgtcactgcttgttgtttgcacattttttttaaagcacattggtgctagagaaggcagctaaaggaagtgaatctgtattggggtacaggaatgaaccttctgcaacatcttaagatccacaaatgaagggatataaaaataatgtcatagataagaagcacagcatcaatgatttcaccatataaatgtggaggctatcaacaaagaatgggcttgaaacattataaaaattgaaaatgatttattaaatatgatttctcaattgtaaaaaaaaaatgcccccattccagggtggcaaaaatagaaattggattcccagaacaattttcaagctttcaaaaaggctaactatcacaccattactcaagataaactacacagtctaatataattgtcatatttacttgcttctgcttaaaatatattaacccagtttgttaggttgattatctcattctgaacagatgcttctattgatggttatataggtcattaataatagggagaaacatgatcactttataagtcagctggtttagtagacaaaaaaaatctttcaaaagagggtgttttattaagctattaaaaaaatccactggaaaaaataaataaaagtttgcttgccgaaatggttggaaaccagtggctcagtcagtgcttctctgacttgtccatgcaattacttttaacaacagatgcaaatgatagtctcaaggacacctgtgttcttaacctggaaaaaagggatagagttttacaaagtttcccttttttcaaaatcttcaatttttgaaaacactttccattcttctccataatagacctatttaatttctaaataatatgcttaatcaaaatctgcatgtaaaatttgatgctccaagaagacacattcattcatattgtgtttttagaggtgatcattgcaccccctacttcacccaccgtcaccactatattacattagagtttagatatcccagtttgaggtgcgctgggatgtaaataatcttgcagagctcacccagctataaaattctgtctttagtctctgaagaggcaaaatgcattatcttgaagaggtggaattcctttatcattataactcaaattgcatctaaagcctagaaggaaagggaaaatgcagaaacaaaatgtgtggttctagggaaagcagaaaaattgtcagaaggagccaagcatagttcaagagaagctgtccatctgaaatgccacctggaattcacaccagtaataactgttgtggatataaaaattaatagtggggatttcatagtattagaaaaatttatttttataaatcatgtgtctgtcacccaagtgttgacgcatgcatgcaattcaaacatcaggcatacaataaaaagctcactggataacttaacaaggacaattcccccattttctctataatttggagtggaagaaggaggggggagtgggtagagagtgcagttactgggtcaattaatcaacctgaaaactgtgacacaaactctgacgcctaacctatgtctaaaaatacacaaatgtatacgaatttgttttaaactgtcaatgcctatatttaggaccttcccagcaaggctataatgagactgtgtttgagggcttcagtcatagcagactctaccattaatctgaagttagttaaattaacagcatttagtactgacttgtcaatctcactgctccaggaaattgcaccttgaggctactaatattgccaatttttccactggagtgtgcgcccgcgtgtgtgtatgtgttttttttttctccagaacctctgcgttcataccccatcattgcttccctacgtccacagcacttatattatcatttattctggcctcctttagccttccccagggattctgcatagtgtagctgctcagtgaaagagttttttagctttatatttatttgtttatttttctgtcatggctcatgact

SEQ ID NO: 1570 - DNA, 2198 bp, Homo sapiens
tattggaaaacttgtctcatacactcaatagggcctctttttccctccacaccatccattcccttatgcccatcctcccaggccctgattctgtgcttcattttcacattgaactgatagttgtcctccacagtgctgccagaaagattctcctaaaatgcccctctatcctgtgaatagtctgactgagctaagggacttggtaactactgcagcaaggagcggggaaagcatttgtcacctgtagatcacattcatggaaagtacttccctttacaacccatccagtactggataaatctcagaggacttaatatacataccctttaatgctcttctttaatcttttattttggtacagcgcattctggcttctgcctttttctctcatgccaccttcatctctttctgtacctctacaccccttccctccagtcataaaacactggatgtggtttctgggaagaaatgtgtactcctgcacactgttctgtttagcatatgtgtgccccttgcctttgatcagcaacccccatactcttaacttgtcctttgagactccagcaaagctctgatcctcattcccgagccaactcagatgtccctcccttgtcctttcctctcttacagctccttgagaacacagacagattctagtttacctctgtgtccccagctcctttcacatagtctaacacatagaagatgctcaagtattttttgaatgaatgcttgaatgagcagacttaccgtgcatgtggtgtgttcctccctggtgttatttccattttaaaataaggatactttaaagtcattgtttgaccacagagaatgaggacaaacttttccttgcaaataaatatttatttgctttctcctgtgacactaaagatctctaggaattactatggggtatggtctgaaagtgacagacactttccccctcttgggacatccctgcactagttaacatttcccctctgatttccccttgacctgctctgtccaggtcagaggattcatagtgcgataacacagtggagaaagtaatggtgtcacaagtggatatgggaagttaagaagctgcagcaactttttggctagagctttctctttcacagtgttcatttttccaactgaatgctgtcaatagaaagcattgtctttcaggtgggctcacgcctcccagcactttgggaggccgaggcaggtggatcacctgaggtcaggagttcgagaccagcctggccaaagtggtgaaaccccgtctttactaaatatacaaaaatgagcccggcgtggtggcgggcgcctgtaatcccagctactcaggagactgaggcaggagaatcacttgaacccgggaggcggaggttgcagtgagccgagatcgcgccattgcactccagcctgagcgacaagagcaaaactccgtctcaaaaaaataataataatatacaaaaattagctggatgtttgggcgggcgcctgtaatcccggctactcgggaggctgaggcagaagaattgcttgaacctgggaggcgaaggtttcagtgagccaagattgctccactgcactccagcctgggtgacagagcaatactctgtctcaaaaaaaaaaaaaaaaaaaagaaagcattgccttttacatacagagttgtttgagatttaccttccacctctgttagaagaggaaattatttttattttatagcctttgtctacaccataatcaaccactaagttcatttaagtagagtgaaaatgtcaacaaagtattcagttacacaaagatatatagtgaattccattttaggacatgatatttaatgcagttaagtaaatttattttgaaatacgtttttagtattttttaagaatgtgtaaaacgtttagtacctccacacacaatgtttagaaacaaacatgaacacagagagatttgtctgttgataagtaactaatatggtattgtcctttttttttttttttttttgagatagagtctcacactgccgcccgaggtggagtgcagtggagcgatctcggctcactgcaacctctgccctctgggttcgagctattcttctttctcagcctcccaactagctgggattacaggcgcccgccaccatacccagcttagttttagtagagatggggtttcactatgttggccaggctggtctcaaactc

SEQ ID NO: 1571 - DNA, 1728 bp, Homo sapiens
ctgaacaacatgacgaaataccatctctacaaaaaaaatcaaaaaaattagctgggcatggtggcacacacctgtcatctcagctacttgggaggctgaggtgggaggactgcctaagcccaggaagctgcagtgaaccaggatcgtaccatggcacttcagcctcggtgacagagtggttcacacctgtaatcccagagctttgggaggctgaagcaggaggatcacttgagcccagaagttgaagaccagcctgggtaacatagtgagactatctctacaaaaaaaaaaagaaaaaattagccacgtgtagtggcacgcacctgtagtcccagccactcaggaggctgaggcaggaagatcacttgagcccaggagttcaaggctgcagtgagctgtgattgtgccactgtactccagcgtgcatgactgagtgagaccctgtctctaaatatttaataataataattctggtctctgaagctacttcttctaagaagcctcccagagccccaggcttgcttgctcccacctgggaacctccggccccaccccacccccaccctgcgttgttcctgcctccacagtctgggtgcacgtgccttgaagccccatcagtccctgaccttgccagtaaggcatatggcagatattcagccaatatttgttccactgaagctgcgctcagtcctggggaccccttcagcctggccacagagcagggctgagcacccgtggaactctccaaactcagagttggggtcgcatgcctcaccaaggtccaggcataccccagcccactcccagagcaaacacccccaccccaccccagggagctgcagggtaacatgtggccatgactctcagtcccagaactggtagagcgagttcttcactgggggagaggaacaaaggctaaaggagggccctggggctggggtttgctggcccttgggccctcagccaggacagccctctggcactccctggagcgcagggacatggcaccccagtctgggtggcctggagccaggatggggtaaggaaggacatcccaggaaacccacagagccatctgggagtgcctctgggaagccgccatccctgacacttttcccacctcccaggtagctactacccccttcaaagggcagaaactaagcacaagcaggcatgacctctgacctagttcatcaggcagtgtcaccgggggactaaatccaaaatgaagaaagagacttactagcccattctggaagcagaggagagatcccagccatgacagatctcagccttgaactttaggaacaggactttgcctccctgtttcctcagcttgggcctcctctcctggtcccactgtggcttggacattcggatttggtgaccacctgcccaggccaagctgatgctacaggcattagtcagggtcactgaggccccttaggcttctaatgggagaaacgtggctcagcgcctgcctcaatgaccccagttggcctccacccagcccgcccaaggaagcttctaatatctgatctttttttttcttttttgagaccgagtcttgctctgtggcccaggctggagtgcagtggtgcaatctcggcttactgcaagctgtgcctcccgggttcacgccattctcctgcctcagcccccgggattacaggcgcctgccacgacgcccggctaatttttttgtatttttagtagagatggggtttc

SEQ ID NO: 1572 - DNA, 2199 bp, Homo sapiens
agaatattttattctttcatctttaatgtttctctagttttctcttttaggatttagagatcattcagtctcatctcaaatatttcaatttccatgtggttctttcataaacatttatccacagtgagcctgccctgcattctttgggtgtggctgacagttgcagccaccctcaggtctgcgggggtgggtgtgttgcccctgaactgcaatagcagaatttctccctagcctggcaggggagtgcaatcgtggacttgcttttccacccgctggggttgcatttcataggtgccgagtgcctggggggcccaggccttttcacatgagggttttcagcccagatgtccctcctgctctaggggaacccttcacatcagtcaggtgacttgctggactggtagagcctctgccatcagcctctgatgcaaaaccttttctcaggtgtctgtgcggtccatggagacccgagttcccaggtttgggagggatgccactttccttaggaagaacagcaatgtatgtcgtccttcccatccatgcagatgggacagggctctcaggaaatctgccattagcatcgccctagaagatgcacaggcagaggcagctgctgggcacaggcacttggggaagacaggagccatgacgccacgccacctgttggtacccaaaggaagtggctcttttggctgcttggcaccattcttatgacccttccattttgtttctagtctcagaaggggtggagaaagtcatccttcctaaatggtgttgactctcagacatctgaccgtgccaggagaatggctgtgcaaggcggcagcccaggcccgggcaggtggcggccaggagttgggaccacagagggcactagcaagagcagcagctgctccgagatgctttggcacaagtcaggatacgtattttgtagttttctcttgttttttatttttctgaggtggagtctcactctgtcgcccaggctggagtgcagtggtgcaatctcagctcactgcaagctccgcctcccgggttcaagcgattatcgtgtctcggcctccagagtagctgggatcacaggtgcacgccaccacacccagctgatttttgtatttttagtagagatggggtttcgccatgtttggtcttgaactcttggcctcaggtgatctgcccccctcagcctcccagagtgcaaggattacaggcgtgagccaccgcaccccacctcccggccttttctcttgtttcattttggtaaactaaattagtttaatacctctaccccatcggtggttggaattccccacctcaatcattttgggggctctctgcctcctttgaataggacagatctccaggggtttacccaggctccgaagagccactccaggcagccggctgtttggggaggtgcaccctggtcttctagtctgcggattccctgcatcgctcccctggtactgctctcaagctcaagggtcacctcagccagatgtgccctaggctggcagaggtccttcccctaaatgcagctgggcaggatgccaccctttctacaataagttcggtcccagggattcccccaacacacacacacatacattctctcttactcacatcctcacacacactcacacaccccaccacactcacacactttcaaaatccaccgactctcacgctcacactcgccagccctttcccttgctctgtcacttccctccaagtccccgccccacacagcctcctgcagtcccagcccccttggtgccagccatctctggtgccagccatctcccccaaatatccacccttctgggctcctttctgcccagagggacctgaagtttccctaggaagcacttgctaaaggcctccagtctccaactcctggggaagaaggatccaggcctctgccgcacaaagcctccactgttctcttggggctggcaccccttcctgtggccctgtggcaccaaacaaattgattcatccagcgaatatttcttatttactctgttccacatggtggtgagtgaatcaaccctggactctccccacaaaggacttaagaacacgcaggtcatgaacaaatgaacacttttgcataatttttatgaccaacggtgaccaggccaagagcaggatgaggtgatggagaataccttggcctggggcatcggaggaaactct

SEQ ID NO: 1573 - DNA, 2466 bp, Homo sapiens
agtcaggccaatggccttggctcagacccacacggacctcagaacaaagacgcagatttgagctggtgaagcccccacgggttcagcctcaccagggttcacctgtggggctcagggtgagcacatctggcttccacacagaggctggtggtttgggtccaccctggagggttctgctggcaattgagtcctgagcaggcactggcagcagcaccgatgcccgtggcagggccttctagtgaaggggatgtttctcccctggacgtggtctcaaactcaaaggggacaaacacagacttgaaattgtctgcaaattggcaaggaatccctaaactctggcttccactaattaactagctgctttccaggtaactagtaggtactttaggcacttgttatgtaagaatcacaatcttaaaaaaaaaaaagttgcaatgttcgatgaggccatggtgaacctaagggtgccaccttgtctacctgggccatcactcggcaggcaaagagattcgatctggctggcaaatcttgttctttatgtgagcaggacaattctcaagtaacatgctaacttccctatcttgagttgtcggtttcatgattatttttctaggaatggaagttaagcttgccgcttcatcatttctagaaatgtctttaccccctttaaaaaaactgtctgtggattgggaaaaacctccagccccttgttactcaggcctcatctcctaaactgcctggctgctgctgacaaagttgctgagtagacagagcttacaactggggaggtgtcagccggagcccttgccatggtgatggctgattcctatcatgagtggaacaggagcattttgggcctgaagatctggatgctccgggtggtgtttgctcagccagcagccaagaagtccagcaaggagggaagaggagaaggaggtctgtgtgcttcacccaaaactccagcacggaggatgctgctgagccaaaacccaggagatgaaactgctgggggcagaggagctggggaggtctgggaaatacaaacagcagcaaatctccccactttatcttcatagccaccaccccttacaccatatggctccccctctcagcaatgcagttgagcaacggtctcagccataccatagtggtgagggtttcatgatttgcctaatgagaggtcttactggcaaatttcatactaagagttggatgttgaaatttgactgtggggccacgtgcggtggctcatgcctgtaatcccagcacattgggaggctgaggcaggtggatcacgaggtcaggagatctagaccatcctggctaacacggcgaaaccctgtctctactaaaattacaaaaaaattagctgagtgtggtggtgggcgcctgcagtcccggctacttggaaggctgaggcaggagaatggtgtgaacccgggaggcaaagtttgcagtgagccgagattgcgccactgcactccagcctgggtgacagagcgagactccatctcaaaaaaaaaaaaaaaaaaaaaaaaaagggatggagggagggatagcatttggagatatacctaatgttaaatgatgagttactgggtgcagcacaccaacatggcacatgtatacatatgtaactaacctgcacgttgtgcatatgtacccaaaaacttaaagtacaataattaaaaaaaaaaagaaatttgactgtggaaggagggaagacatgagggtgggcggagggaaaggaagccagcaccggatgtggctttcccggaggcagcccactggaaaagcggatttcattatagtcaggtggttgttttttaggtcacctacttcccagacggtttttcctgcttttctttcctgttacaaagttttgacatattggagccgggaaggaagaaaagtcgcactgtatcaccaagaagtaggggacccaggggctcagtgatccacagcagaaaggaagaggcgaggaaggtaggagatgcagagaaaggaaagaggcagaacgggggctcctgcaagtgcggagatgaagccctgtcccaggaggtcccacttgggctgccggagtggtgatgacccagggctcggcctactttcagcctgagaatcctgagagaaccccctccaagagcagcctgggcagattggtcttgtctgggctgctggtcttgtctgggctgctgggctatgtctgggctgctggtcttgtatgggctgctgggccagctgttcttatcctggctgctggtcttgtccgggctgctggtcttgtctgggctgctggtcttgtctgggctgctgggctatgtctgggctgctgggctatatctgggctgctggtcttgtatgggctgctgggccagctgttcttgtccaggctgctggtcttgtctgggctgctggtcctgtctgggctgctggtctatgtctgggctgttggtcctgtctggg

SEQ ID NO: 1574 - DNA, 3434 bp, Homo sapiens
cgggcactgggactccccactgggagagcacatcaaatgcctcctctccacccatggcgcttggcctggcactcaggcgcgatctgcgacaggcagaagggtctgcgttcccctcaggttggacctgtgccctgtctatcctccaaaagcacatgaatcctcacagtctgaatgctaactcttagaatcttactcacacctctgaaaacccgactttccagaaaccgagtacttggacattaataaaataaaggcatgcacaaatgagcgcacacacaaatatgaagacacgggaaccccacaccaatctgtcaaagtctcaacttgttttgctttgtcagatgcacagaacataaagtttaattatggggaaaaacggccagcatatgttcattaatcataaaatgacaattagatctgatttatgtcaaacatgctgagttcaaacagagctccagaaataaattcataagaaccaaagcttttcattaaagattctgcaagaggggatcacattttctatctaaatcatcacttaacattatataaatcattcattaagtcatatataaattatacatccataatttccaattatagggccttacataaaagtttacgtttattggagctctcagacccgaaatgattgccaagcaaatctccctgaggtgtgcagggtgacaggaggccacccccatcacaaccacaccttcctggggatgtcaggaagccccgctgtcttctgagacaatcatcacaagctgttcccaagtcaaaccaagtccattaccctaatgagaagccccaggcccccatttggcccttggccctgtttcttgcttgaaaattaaattctggctggtccgaaggtggtgagttacctcagatgattgttaacagtcagttacagatccaactccttgttctactctctcccctttcctcactattgtacttgactagtcttaaaaaataataaaaaatttttaaattcaatttctggcctgaaatgtgtctcagttctccataccctcacaccttttctctactcacagctagagagctgccaacaagaacttgcctctaccctcccagagaaaaatggtccaaatagatcccactgatgtttccaggagggcaggagaatgaacctggactctatttccatttcacgtattgctccccgccccatcaaaggctacattcctgcaaatacacagctctgctctgtttgccttccttggacactgaaatgactttccaccgacttgggtgagggtcgtgtgtcctccttccacgtgacgagtggctgccagtcaggatgggcttccgcattctgcgctctgctggctgtgatgggggcgctaaagacacagggcctactgcacggggtcctggggccccaaaagaggtggtttctcaatggagatttggtaggaggcaaaaatcaaatccagtcaaactaaatcaccatttccaaaaatacaggcttgcccctacaagaaataaacctgcaacaactcacacataattagcccatctggaattcatcttcaaatctaattaagctctaatatgcagaaacatttttccagcacctgttcactttaatctccccctctagggatttttcttgttaaatgcccctctctcttttttgtgtcatgctattctctttcaaacttaactacccaactgcatcttttccactccccaagaaaataaaggtgttgtatccccctttcctccctggggaaacaggtcacttctacctctcccccaagccttcactcagatgttttcgccagccaatccctaggcctacacaccattttaaaaggcaattactttttatgggccttagaaaatgtcagttggaatgcgctgggaggaggttgtcttaattctaagtttggcagccgtcaaagtgtcagcagctttatctccacctggagcgaggcaccaggaggtcggaggttgtggccccaacacctcgccacccgccagaggccacttctggaagcagtggcgccaaggtcttgacaccaagagaaatccagggatcgatgtctttgttagctcaaaagcaatggggatgcccagggcacagtggctcatgcctgtaatcccagcgctttgggaggccgaggtgggcagacggcttgaggtcgggagtttgagaccagactggacaacgtggtgaaactccgtctctacaagactgtctccaaacaaacaaacaaacacacacacacacacacacacacaaacacaaaagcatgtgggctttatgccaggacaacagtgaattccattgattgaatggcatcaaccctgctttagaaaaggtaaatgaaatcctgaatgtgctgcttttctaagaactggcaagaaggggcacaaatgacaccaggatctgagccgccacaggataactcagaaaaaacaaagctttcagacactcggttacttttctttttttttgagagggagtctcgctctgtcgcccaggctggagtgcagtggcgcggtctcggctcactgcaagctccgcctcccgggttcaagccattctcctgcctcagcctcccgagtagctgggactacaggtgcccgccaccacgcccggctaatttttttctattttttagtagagacggggtttcaccgtgttagccaggatggtctcgatctcctgacctcatgatccacccgccttggcctcccaaagtgctgggactacaggcgtgagccacagcgcccagctgacacttggtttcttaaaagcaccacttagaaaatagtccagtccgtgtgcaacgactggatgcacacagaactggcagctggcatttctcaggggccagctgtgtgcacagagccacttcgtcctcacaaacacactggtcacaggcactactgctgtccaagacaggaagggttacaaagatgagtgaacctcctaaagcaatcggcaaggacagctggacagctgtgtagagactgggccccccacactacgtgcgcaggctccccgcctcccaagtcagtgccggtgctgcagggccagggcacacgcaggcctccctcctgcctttggggaaccttgaagttgaggctcggaccccaacagccgtctcacactgagtaagactctcccacctccaccgcaagggaagatgcaaaattttctcttaagactgggaatatgctataataagtgattcagaatctcttctgtcgatggcagtttcttgattaattgataaacctgcctgaataatgctggaagcaaacacaatctcctatgagtgaaaaggcttgttttaaaaagttgcgtgctgctgggtcttgtgccagcaaatacaagtgggttacagggctatagcaaacagagcagtttggtaacaacaaaggaatagattgtaggt

SEQ ID NO: 1575 - DNA, 2317 bp, Homo sapiens
gtatttgctgatgtcgagagatgttctgtttccctcagtcttcattcatgaatcagtctctctggtcattcaatcattcacctatttctaatttcctcctagttccttttttgtctctctggtagtaaggaaggcaaaatcaaatggaaccccagagcattgctagaatggaacaattcctgattctatgaggcaaatcatgtgacttatctgcaccattttgaaccttagaatctgggttctgagaatctactgtgaccaagttgcaacactgtgctcacttggttctttgcagagaaatagctacattaaggagatggcatccccaacttttgcctgccttcttgcacactcagactcttactggtgcttatgtgcatgcacgtacgcatgcatgtgtgtgtgtgtttaagagatgcatgattctgtataaatctattcacattgaaaaaaagaagactgaagtggacaggctaggtatgataaaaccacttttgaaagctttggatttagccaaatattggggaagtactgttctgacatagtctcttcagaaagtatttgagctaagctgaagtttctatgacttaaagttctgttggtcaaagtaaactgtcagtgtctgattggtagggagtaatatattcaaattccagttggttgattatgcatggagacaagcaagcttagaaactgcaggctgagaggggagtgctgagccacagtgtctctgctggagtcctggctcttttgattcagaagagcatttctccattcctccttaattcacagaagaatctgtcatttgcaggaaaggaagagacagcagcagctattagcttgacccacacaaaattgcagtttttaaatgtcaaagacagttgagtatcagaaattttgcatggttctaccaaataatttaccaaaaatgtcagccccaacctcatcaacagtgaagcagttgaagagaggatatacgctaaataaacaaaaagttgccagaccattgcagacaaagttttaaaagaaaaatgttttgacagatacaagtagtcctctttctttataatggaaggaaacagagtgattacaatttaaaagaatatggaagcataatttttaatatctgatgacaaatgaaaaagtaaattttattcattctaagagcagcattcctgaacatgtttctgtctctgagttttaatgacgttagggtttgcaaagcagcaacactgagcccctgaggctggacccctgcattttgggtgtggtccaggaggctcctcagactgaatcttctctccttctttccacggcaggggtacctgattccaccagttgggacagtttccctgtattcccaggacttatcctgatgtgaggtcacaggtaatccattaagctcagtcctccatcttaaagtccagcagttccagctgaagcagtgccccggtctgatgtctgtgcaaatgccatgctcagaagccctagtcagccttgtgggctccggttcctctaactcagcatccactttgatccctgtttctaaatgtcttgccctctgctttgactagactcaggtgccttcctggtatggacaccctaagttcctactttgtttttgccatccccttcccatgacacgacttctgcctcttactcttaaacctaggatgtgaggctccacttcccagatgccacctggccagtcttctatgtgcttctcaccccgaattattccctgccaggtgctgtgcccgccaattgggatccctcccttcctcttgaactcttcctatgtggctctgattccaagagtctagatggtgattactgttgccaaaccccttggataccagattctgctcctcagctatactctcctcttgcatcaacaatgtttcattttctcctacccaggcaggagacttgattcccacttctctctgagagccctgttctgctaaaagggtgggtggtgctctgtgacatcctggaggtggacagttcacagcaggaggttataaccaagttgtcacgacttacctaagggtagcttcccagcctgtgtgcggctacaccctcaggtgaccagggggccctggggcaccagagtcccagaccagtccttccagcctccagcaacctctaggctctaagccccctcttgttcccaaacgccaatggtcattttttctctgtgacgtgacatttaaaaagttgggaagcatgacaaatttaagcaaaatggcaaagatgtaatagcctcttgagtgctgcagttcaaaacataaataaataacccagaagtcagcag

SEQ ID NO: 1576 - DNA, 3168 bp, Homo sapiens
ccggtccttagactgtgcagcaacacatgaatagactaatatgaaatagatgctttaggtgagtgagctgggacaattggattcttgttctcaagaatcagaatgtagaaatatagggagagaaattagtgatgagaaggagcttacactaaatccggttgatgagttagagcagggagtaaggaattgtaagcaaaccaatatcaagagacagacaaagacaaagaagattttatagaaaacataaataaagagacacagcaaaatagagaatgaaaactaagaggacaaagtaaagtagcaaagaatagatggagaagtaagaagaccagacatacagagaagcaaagattgagggaataaacaaagagaaaactaaaaagaagatccaccacaaattattgtcattgtgattcatagaggtgctgtgtgaccagaatttctccatctgagagaatcccagccctaattgctcctcgcaggagagtagcttaggtctcctcctcattctcacattccccacatcttgaactataaaaatggctttattgtaacaaagtaaaactttcagtttaaataaaatgtcttagaaacatttggggagatagaggaagacctgtgtattaatagcaaatgaattaattaagctaatataggcatttcttcatgacattaatttttcccacctcccatgtgtgacattgctacctccctccagttgctcatgttgtccttccacatggaaaatgtctttccaacttctttctaactttataacacctagctatttataaaatgcccagtgaaagcctcctaacctcctgattactctgcctatacaatatctctggaaaacattcctcagcggtcgtttttacacttaatactccaccccttatgcttaaattgttgcattattaatcagtgcattgctattttacctgttttgtgtatatagctaatcttccctgcaaaaaaaaaaaaatatgttatttgagagcagaaagtggggtaggcagattaattccttttatcatgatcatatgatatcccccgtattagtccattcttatgctgctatgaatacccgaggctgggtaatttattttttaaaaaaaagaggtttaattgactaacagttctgcagggctcaggaggcctcaggaaacttacaatcatagcagaaggggaagcaaacacattcttcttcacatgctggcaggagaaagaagtgcaagtggcaaaatgccagatgcttataaaaccatcagctctcctgacacctcactcactattccgagaaacagcatgggggaaaccaccccatgattcagtctcttcccactgggtccctcccacaacacatggagattatgagaactacaatacaagatgagatttgggtgggggcacagccaaaccatatcatcccccaaagtagtagtacagaaaaaacatatataaataaacaaaaatcaaataaataaatgaatgaatggatggataaattagtaaatttagggtagttcaaaggcttatataaaattgttcatagggaatgcacaggaaaatttcttgtttttttaatgagcaaaacactagcatttgtgcatcagttcctttgagtgagatgggcttccttgattctttctatgaacatagttacaattatttttatcaccaccaaaaaaagccttgagtggaaaaatatattttaggtatcatatcatcataattgtatcctatcagtcttcctatgcatctacttgtgttaaagagggtgtggcaagaaattaactacttatagaagataaactgacaagaaggacagaggaggacttgacaaaaatcaagatattcaattggaattgtttatttttatgttctttttaatttcgggagaaaatatctttcatctcttctctacacttgaacagcaggtgggcagacactgaaatttttcaggagactgagcgtgtgggcaagtcacttgcaagaagttcaaacgtcatgtatactactgatattgacaactgtaactgcaggacacaggagaagcaatcctagctggggtagagctggcattttcaaggtatttttttttaaaatataaatgctctgacactgatcgaaaaccctagttcccgagggctttggtgtgtaactgcaaaatgtgaggccagtcatatacaaaggcaaggatggaagattttgcttgaataaaattgggagcagcgtatatattctgccacttctaaaatcaactctggcttcttgagttggaaaacaccagatttgctattcattctttattattattattattattattattattattattattattatttgtttccaccactatctttgcctttccagtgtcttgacaaagtgaaatgtgtttcaggatcgtaacaagcagttttgaaaagcattcagttgagtttaatattgctctcctgtgtttcctatagcatgtgtacatgacacctgtatgtgtatgcatgtgtatatgtgtaaatccaacttgtgcagatggctgcattcatttttcaaatagatatcacagcctagtccaaaagtaattgataagattattcaatatgaacataggtgttaaaagatctggaaagacatcagtgcaggtgtgaagctaattaaacctgttgtggggggtgcacaggaaagatcatgtggcctatctctttgaagaaataggctgtcgtttttaaatccatattatattttattttattttcttaatttccttttaattgtcttataatcattatgagacattatatttcactaatataaagacattaaacaaattatggagatatagagatattcacattctcttttcaagcaaaagaatatgaattttcactctggctggctttgattaatctcccagtgattttacctgaggatacagcccaatggctaggatagaatggcagaatttctgtagaccaatcagaaccatgggctcaaaaggcaagcatcgctttcttctttggttgtcatggcttttctttctttcttttctctcagattatggcattctgtttgatcattttcactccagagctaatctttcacatttgcagttctgtgtttatttatacttttttgttattgttgtttttaatactttaagtt

SEQ ID NO: 1577 - DNA, 3897 bp, Homo sapiens
cgctacatctatgtgtacatattctttagctcccacttataagtgagaacatgcagtatttgtctttctgtgtctgacttgtttcacttaagataatgacacctagtttcatctagttttcattttttatggctgaatagtattccattgtgcatgtagatcacattttctttatccaatcatctgttggtagacatttagtttgtttccatatctttgctattgtaaatattgttgtgataaacatacaggtgcaggtgtctttttgatatagaaagtattttccttcctcattgaattttattattgttttagaggaaatgttcaatgagagttgagcattaagatgtttctaaaactggccctgacctaccttgctaagctccagattttcttactttagagatgggaaccatgaggcccagaaaattatttaaagtcaaagaacaagtcagaggcaaagtcaagagtgaaacctccagatattgatgccatgtcaatgaacttttcattctgtatgttcttctggaataattacatctcacattacaaacatttatggaaaatctatcatgtgccaggcactggtctaggaattaagcacacaataaacgtaaatcctgtgctctcagtttacaacccatggggaagacagactcactaaaataaataaaataaataaataaataaataactaagctggctaggcgtggtggctcacgcctgtaatcccagcactttgggaggccgaggcaggtggatcatgaggtcaagagattgagaccatcctggctagcagggtaaaacccccatctctactaaaaatacaaaaattcgctgggcgtggtggcgcgcacctgtagtcccagctactcgggaggctgaagcaggagaatcgcttgaactgggaaggaggaggttgcagtgagccgagactgcaccactgcactccagcctggtgacacagtgagactccatctcaataaatacaagcaagctagcgactgaaccacaaatcaagtcctttttggatgaaaacagggtatcaaatgacaaaaaactctccagtgtgacagatgtgataacaaatggacatattgagcccagtggtggcagagagcaggagcttattgacctaccatgagtgggttagcagagacacctcagactgatgactaacatttgttcagaacttatcaaatcccatgcactcttccaaatgcgctatgtaggttaacttaggtaaccctcccagcaatcctgtgagggtaatactatgattagtattatttcccactttgcagaggattaaatcaaggcaatgagaggctgagtgactggcccagccagtcagtcaacaggagccagagtttgagctccagtctctattgcccgcttgcctctctctacccagtatgatgcttggattggcaatcaaaggatgtagagaagaagctaattctaggaagagagaatgaggtgtttgccgcagggtgctgaatttatttagaaaactttaggaaattcacttttgggaggtggaggtgatctttgcgcggtgggggtgaggtgtgctccgccatgaggcatgagccttaccaggccttactgaggagcttggctcttctccattaggcaactggaagccattgaaagtttaagcagggaagaaacacgatgcagcttgcctctttgaacaacttcgcattcatcagtccaccaagtgactgagatgggttcagccagcttctagatccctgatcctgtgaccagggttcggccacactcttcttccagtaaaaaaggaatggcctcaaatggaaaccattgctacagggggttaataaaatctcccagggccaagaaagctaaaccacaatttaaaaaccttcctgcatagctggcggctgcagtgcgtggcttgtaggggtgggtgatctgtgtcatcttccttgacagtatattgctttgcatcctcctcataaacatttctgtttattttgtgggagggtaaagtgccgacagaagttatccaggaggaaaacaaagaaacagcaggccttaaatcttcatcaagtttcagaaagcttcaaaccaacacaagaaactctcagatttgggacttggaaaactgggggctttacctgcctcctgcctccctcccattcctcgctcctgattgcatgacaccctttccctttctcaagtcttatctctgaattccacctcctaacagaccaatgttctcatagtgccaaagcctcatgctgcagttccccagggcaagcttgccctttccagaactgcccacctttcaaaattacttccttacatttctagttacagctattacactcctcctggggctgagctcaatcaaatatgtgttagaagcagagtaatttaattaaattgcatcccactaaggtataaataacgtatagccccaaacccatccctacaatcatctcaggtatgtggaggtcacatttcaggatcccttagcacatgcctcctttctagacgcccttgccagaagctgaggcagacttgctccttgtgtactctagcctctatcctgcagtttttgaaacatttgtattcacctacttaggaccagctgctgtcccttcccccaaacttggggtgccctggcctgttccctacaaatctgtgaatgtttgtctttgctgtgtggatcatattcagtctcagagcttggaaacaggaagggtagacaaatgattaggagacaggggccacgtgtggtggctcacgcctataatcccaacactttgagaagccgaggcaagcagatcacctgaggtcaggagtttgataccagcctggccaacatggtgaaatcctgtctctactaaaaatacaaaaaaatcaggcagatgtggtggcagatgcctataatcccagctacttgggaagctgaggcaggagaatcgcttgaacccaggaggtggaggttgccgtgagctgagattacaccactgcactaaagcctgggcagcaagagagagactctgtctcaaaaaaaaaaaaaaaaaaaaaaaagagaaaaggagagagaggtgtcgctaaggatgaattatgtacatctaaaagagaaatgcagttttcttgaaaaaacaagtttatcagatgtgattagaggagtttgcagtgacaatcgaatgatgtgacaaaatatccggcaagtttatggttgggtgatgagtttggactaggagatgggggactctctaactccaactttgtttaagttacctaccatctttgggtctaagtgtcattatctgtaaaatgagtaggttgggccagagagcttcagctccttttagatctaattgtaattatcaagtattggatatcacatgaagactttggacctgtgtgctgtaacactgacctcctgttctgtggactactaatttctctgctatagcgcatatgaaaggccacactcacagagagacatggtagaaaggacactgaacttggaaccaaaagacctgggttccagtctgggttggcctagtaatgtaaacaagtggtgtttcagtttctttgtctataaactagggttagctattcctctcctgtttttttttttttctcatattggaaaccacacagctacatgcttgctgactctttttattgttttcagaaatgtctctgagctgtgtgtggtgtctgacgtgtgtaattccagtgctttgggaggccaaggtcagaagatcaaatgagcttaggagtttgaggccagcctgggcgacatatagagaccgtgtcagaaggattgcttgagcccaggagtttgaggctgcagtgagctatgatcatgccactacacaccagcttgggtgatagaacaagacccta

SEQ ID NO: 1578 - DNA, 4912 bp, Homo sapiens
aaatgcttgttattataagccactaaattttgaagtgttgtgtgacacaacaatctgtaaataattcagaatagtaaaatatgaatgggaacacaaatgtacagacatggtataaggaataattggatggtcacagtgggtcatttctgccctctcatatctcagagcgattacaccctttaacctctacttctcccctcttcctgaaaattctgctcagggcttaggcttctaggaagcttatcaaagctagcctctttgcttttcattggtgttatttgtgggtgtttatcccattaaggctgtgggggcccagcccatatggcagctttaaacctgatgcctttttaggccctcagctgtctgaacaggaaagaccctggggcccagaagatctctcacttcttagcacagtgaggctgctgggcctttgacattgtgtgcacatctctgaagaattagagttggggcaagaaggaacagaaaccctgcaaggaagatccccacccactgctgtcttttgctgctatttcagattaagtaaagcaaaccctatagatgggagaggcgctcttctgaagatgacattttccttaactagatacaaggagacaagtgacctgagacaggaaagcaggctagccaaataaatgagagtatcagccagagttcttcatgcaggaaacaaatcatttaatttgtgttaagcagaaaatgatttaatatgagaaaccggtgcttagaaaattagtgaaagggctggaagagcttcctttaggctggatctctgggaatgatatcctgagcatgcactatgcccaactgaccaaccatgaaaggtggaaatcaggaggccccagtggacctagtgatgtaatctgcaatctggggaggtcattgctgcttttgcagcagctcccttcaatatcctcagagcttagtgtttgcacctgcagctctgcttagcagcctaaggtgtccatgccattagccaaactctcaggaaaattgccctggcattagtcccagcttccaaatctcacacaagtatatttaatggacagaattccattctcaaccagaactctagaggccagggagtcagtaacttttagatttccagactctgaaattcagaaaggcacattacaaagaggttggattaatacttaatacagattaaccatttctaaggcagagggcaagctcctaacaccatggctgagcttctttctcttctagatgtaaaattagaggaatctagatgtgctcaaaggagcttccagatgacagaggttaaagataacttctgtaccattgaggtggctgaggggacagcaaatgatcctctttaggggatcccaattgaagatgaatgagccaagtcttatttgcatgatctcattcctgtttccttctttacctgttgctatccccacacctttgataaaatctcatctaaatatttcagctgaactcagctggaattaagaggagatttttatggccaaattaggggcaaagcataaaaagggaaacatgatggtgacagcagtaattatagtgaaagattcccaagaggaagtaaaccttggggaatgtcttagtcttctcaggctgcaataacaaaaatactttaaaaaggatggttgacttataaacaacagaaatttatttcccacaattccggtggctgggaagtccaaggccaaggtgccagcaaatgtggtgttgatttcctgattcattgatggtagtctttttgctgtgttcttacatggcagaagaggtgaatgagcttcctggggcctcttttatagggcatgaatctcattcatgggctccaccatcatgacctaacggcctcccaaagaccccacctcctaacactatccctttgggggttaggatttcaacatatgaattttgaggaggcataaacattcagaccacagcatggaataagcctcagccaccctctctgcatagacatcctttccctgtgctcatctcacaggatacaggcttattgttgtgaagggagctagtagtattcctgcgagccagacaccacagctcagactccttcccccagccccattcagatgtaggaaattaaccaagtgtcttaacatcttaggccttcaccgcctcatctccaaatgtcagggggctgagccagaggagctctccagtttccttccagccctaaaatccatgagtccaggctcatgtttataccagaggaataacaagtgagaaggaggaatggggctgatatctctaccacctgccacaatgccactagacagtggaagagagatcccttgagaatttgagtgagtgtgggtagttgtcagaatagggcagattaccatcaaggtcaattgcaagagcaagaatctcatctgagatcagaatggctagcaacaggaggtggtggcttctggagagtccttgctctgaagatggtcttaggtgtccattctgggcccattcattggcaccttcctctcccaaattaatgttttcttatagacctgggctcttttagggcaagagccccatctaaacctgtcagccgtcagcatctgagtctgaagctttcgccagcaggcatgggaggtgagctcttctctgtaagaacactttggaagtcaccaggggttatacagatggaagggattatcactgaaatataatttcaacaaaggtggtacaatgctctgttccactatgatgaaatgtgtcattaaatatagaaatagatcaagcaccttcccactgagatcctctggcaccaagtatctaggtgagaagctgagtagctgtgagagctcaccaaatgtgaaagaggtgggaggaaaaattcctcactagggagatatacttaactagacttataaatagcccgatcgcagctcgtttgattaatttggggaaaaggagtaaaagtgttttgacaattcatcagatttcatgctttcaaagcagttgctaatgtaaatattagcatccaaaatgaacaaattgtctttggtaattaaatgccctaatttacaggttccattagcagagaacagagataatttccccccttaaattaacttttctctccttctcccttccctgtctcaacttgataagacaaatggatgtgtaggggctccagagggggctggaggaagtttactctctcttggtctgagtgcagaggactgagtcagtccctgaaggcagagctcagaaagagtggagtgagtacctgctcccagaaagcttaactcccagtggctgtggcacactgagaaatgaccatcccaggggccaggagtggcctgctgttagggtcaggagttctcctagtaactgtgcgagatctgccttctgttgtctctctctagatcaggatgtaccccttggaaacctatactggagagaggtggccaatgacctggaacccaagcctggcccccaatttctaagtcatcatatttgttctttcaaatacctctacctttcaggatctctcttattccacagaactcctctaaggagcctaagactgtgccctattactcaaaacccttggttgactacactccatgaagtgctggctgatggctactacacataagtcctggaatgtttgcattctcatagggggctacagactcttaaaccagcatcagccaaacaagttgagctgaagttaagtggccagtgactcaccacagtgctgagggaggagtttggacaggaaggcctagcttcatccctcaattcatactcaatttcctattatcctgttttatttagggtgactaggtgaggtgagtgaggctcctagggagcaaaattgaagaaagtgtagagctggcatttgcatgcctctgacagtgagttccttctcaaatctgcaccctaggaaggtggcagagatatcagccccattccctctcctcactagttattcctctgccataaacatgagcctgaactcatggctcttaggcctgcaaggaacttggagagctcctctgactcagcccccagtgttcagaggtgaggcagcaaggacccaaggtgttaaggctggacctagacctggatggggtgccatggaggaagatgggggacttaggaatgggattggtggctgggctctttgctctttgatcacaccacacacacacacacacacacacacacacacacacacacacacacacacagagagagagagagagagccctgagaagacctatagtgaggcaagactcctcactattcttctaggtctccagcacatggacaaagggaggaaagcacagaggatggctttgagagaagattggttaaagaaagcgataaggagaagtgggaaagggtcaccagaacctgtggcctggccccatgggatctctgtgaaatgtcctccttcataaaaaaaaaatatatataatatatatattttatatatatatattttatatatattatatatattttatatatattatatatattatatatattttatatatattatatattatatatattttatatattttatatatattatatatattatatatattatatatataatatataaaatatatattttatatataatatatattttatatataatatatatttaatatattatatatatattttatatatattatctattatatatattttatatatattatctattatatattttatatatatattttatatatattatatatattttatatatttttatatatatatatatcaagaactcaatagttactcacatactaagagcctactatgtacctagactgttctaagtgtggggaaggagtggggaagcaaacaagcgtaaggcatgtagcttgccctggag

SEQ ID NO: 1579 - DNA, 1714 bp, Homo sapiens
ttgtttattcccatttctcctgttaacacaacactgtttctttgtcttggaaaaggtactttttaaaagtccatgaaacacatgcaattcatcaagaaggaaaatgctttattaagtcactctatttttcttatctggccttagcattttataacatatcaaatatcacaattttgtaaaagacagagagaaagcgtgcctcttttctctctgttctgggaaaaatactaggctatgaacctagatgacttggttttttgtctgcttctgcaacagtgttcacttggactggtcacataactcgagattttaatattcccatatgtaaaatgtggaaatttgccttagatgatctttaaaggtccttctaagtctataattttatgacttgtaaataaggctttagaggtggagttaatgacactgacatctgagttggaggttcattatgacacatgtacaaagcaaagaggaatgaggccattccatcctttgcttcttctaagatatttaaatacaatgcattagcaactgagagataaaacctagagcagtatcaactggctaccttactgaaacagtgacaggtttttccaatggcaacagaaattcataactaggtaaggagtgttgggagacaattccccactctctcatgttttgcacatcttaaaagcagaggcattagcagccttgtgctccgggctatctctgcgtggatgcttgtagagtgaacagacttggaagacagagatggtgtctctctctagagcagagagtagtttactatcaaatacattaaagatgtctcccttcaaagcaaaggttgggcaggtgtgcttgaaggctatcataaaagactggggattcccaagctctgggttccgctcctgtattgcaacccactgcacttacaggtgtcacctggcccttgtcatgttgccctgtgggtatgggaaccacacaagaaatgaatattctggctcctactactgctgcgagtaataatttatgataaaaaatataaaaaaaggacaataacaaactgtcctttgtccttgacccaggagtcttgggtgtcctaccagaatctacaaaactgtagcaggtaaacttgttagcttgaaagtaggtaaaaatcttacaaccttcataaaaataaacaggaatggaggcttaataattcatggctaagaggacaaagttgaaccacaccaagttacctctgtaacatgatggtgacattcaataaagctctatggaagttattttaaagtttaatttgctgtgtggcaattttgtccacaaaggtctttacttataagaaataaacaatctgataaacatatgacatgtttctttaaagctgacattttgaatgtgccagcagtctaaactgaaattaaaccaattatgaagttttcttgtgtcccatcaagtctgccaagacaccctgttgtacaatactagcaattttttgaataggtaaccattttctactggaaacttataaattttcagagaggagctgtctaaatgttctcaatgtaactccttaagaaaggactaaactaaaaaagcaaaccaagccagatttccctgaaaaacttagctgccttcaaagtaccactggctgtaggaaatacaggaagccagattttcaagacaaacattcctccttcctttcctggttactgctatgccaagatcaaac

SEQ ID NO: 1580 - DNA, 1737 bp, Homo sapiens
cagtcataaaaagtaagcacttcaaagcactaaaaaattcccccgtgtgagcaccttattgcaaacttattactttggggggtagctgagagcttccattgtatctgaaatatttgatttccacttgaacacaggcagcaaaaatgagtttatagaatgtctctgaggtaaatttagccaaaaacaagattaatattaagtgttgtctctggctttctttcaaaggaattttttctcagtgggaggtcatttcttctgtaacctaaagcatcatgatttttacagatttgtcaaaaaatgttagcaattcaaactaggcaatctgatttacacatacttatgtaaatagaacatgtaacagatatgttgagtttaaactagcctcacatagatttggggaggaaggaaattatgctttttcacaattaataaaatttaaaatcacaagaattatcactttatttggcttatagaattaaaattaagaaatattttttcttcctttcacccagagaaatgttaagatgaaatgccttcttacatattcaataagcttctctcaagaatgtgtctaatcaggacttctcagccttcaattttctcatttgcaatgctattctcattcccctttattccctttgttatttggccttgaaaaaaaatggcgagattcatatctctgtccaactgctgaaatctcacaagtttaaaatggcaatgtttttatggaggaatcgtggtgctgtcacggtgatttcagaaagccttacttctgttttgctctctctcagtctttattatgaccacctgaacaggatgaggggccaaagacactgccactgtgtgtcagctaaagagcagaggactgggcttggcctgcagtgaggaactgtagggaatgaggatggatgagtggacaaggaactagggctgcaaagaccacctttgggatagaaggcaattgctttttatagagtgtagtctccaggtcatttacactagaaatgtgtttttagaggaaagaatattgtccattagtgaacagatggtctcagcaggaaaggcatctcaggggcaagttttactcaagtttagagttcacaacaattatcctgatagatgtgtgtgcgtgtgtgtgtgtgtgtgtgcatgcacgcgcatgcctgtgggtatatgtgcacttgtgcctgtgcatatgggatttttcttttagcttgcttgactggaatgataaaataactagcgtattctttatttatttgctataaaatgataaaatgtggttttaacaaaaaatgttttaaaatattgttcattgaactttaacaacacacatacacgaatttttcttgcatttgccaaatcaaaacaggtttcatcctggtgttcttagtttaacaacaatggtctattttacattaaagcctattagtcaaccctgagcacaaaactccatccaaggtggtgactccaactatgacaccccctctccaccatatcaacctagatcttaagtgaaaaagtacaggggaaaattattctcctgcatgcaaagaataggaaaagagaaaggcatagaatgttaagaataatagtcgtaatattaatggcaattacattaatcattgtctttcaagtacctgttttgcgccaggcacaatgctaagtcgtctatgtatattgtattgttgtttctcctgatagctccatgtggtcaagactattattgaacccttt

SEQ ID NO: 1581 - DNA, 1455 bp, Homo sapiens
ttttcttccatctcattgatgttggttttgataatgtgattttatgacttagctggagcttatcaaagactacattgtttttgtctctgaaagaactctccacagacttctgcttcaggaaaatccagtacttcagaatattaacattatttaagccccagctcaagagtaccaagttctgaatatcaccagagtgtaatgcagacaaagaactttggaaatagagacatttggttgaggctgtggactttccttcttcatacctcatctgtaaaatgggcatgaagtatcaaatggccaactcccatagggttattgcaagacgtaaataagataaaatttgcaaaatgccaggtgcatggtaagccctataccattttacctattgatattggtatttctaaacaagaaatacagatttgatttgccacaatgaaggagtatctttacatttaatttcacctctttggggacgacttctttttttgccacagggaaaacagttttatatctgatacagtcaaagtggaaagctatgatgttttaatccagagaaattacttgattacatgtggttttaaacgtattcattggacaaaattgtgtgcatggattgatgcatgggaaagacacagaaactggtgtggggttaccaggctgatgatgtcttgaccacactctgcgttgaggcatcccagcttcctcacctggagaactgggcttcctcaccttcacctgactagctcttccctgccattaaaacaaagcaaagcaaaacaaaacaaaaacaacttccagtttcccttaagtttttatcatccaccagaagtccagctagaatcacttagaaagccctcaatttctgaaccttccatcatgtgtaccctaacggtttccagcccttcctctgcttctaatacttgactgtcccatctgtctggaaggccagggatccacacatgtgtgtctcctgctgcctggcccactggaccgccttccctgtcttctcctcctcctcatgccctctctccacccaccactacaagagttctgcttttaaaaaaatcttatcctctttcccaaagaattcctcaagtcctgagccctacaattttattagtgcttctcaaaagacttctctgaaatataattttatactttaatctcactttcagtgtccagattggcatactcaaatttttataaaatattttctgcttcctactcatattttactccaggccaatgagtctaaatagaatatattctgttccctcctgaaccagctactctatcatgtagaaacatatattaagtagatatttctgttaacactgccactgttttcgaagttattcaatattagacctcaaaggtaaaactgtcttgtctttatctcaatgagaacatccaactgagtgctgtatcttattggtgctgcctcagaatgtctct

SEQ ID NO: 1582 - DNA, 2217 bp, Homo sapiens
aagcacaggtcataccaggaacacactgccacttactgctatggtctgaatttttgtgtagcccccaaattcatatgttgaaatagtcactcccagtgattagattatggagatggacccatcatgaacggaattcgtgcctttatgtaagaagtcccagaaccctcatcggtaacccttccttccaccacgtgagaagatggccatatatgaaccaggaaacagccctcaccaaacactgaagctgctggtgccttgatctgggacctcccagcttccagaactgtgagaaagacatttttgctggttataaggttataagtcacccagtttatgatagtttgttatcacatcccaatcaacactaagacactcactaatgtacacttaacttaggtttccaaatggaaatcttaatttcccattttaaaatatctatgtttctattattttgcagttttctctaaatacacaaaatgaccagtgctgtatatttgcaatgataaaagtattcagatgctaagcccaaacgaaaactctgggtcagaagtgaatttttgctggctccttaaaagtagaatggccatgaggaaggagaaatgaccagtttttgaagcttgggtacactgagaaatcaaacaaaaatgatacgatttttatatactccctcatgatactgagcgagtgttcagtggaaagcgaagggagtgccccgtgttttgcctgtgtgtcttttctagcgtgggtcctggaaccaacaataggaatgctccacagaagcagaggagttgagtggtccaagtaccagatctggagctctcaatctgtagccgcaggaccaacaggctgtttaacttctctctgccttgatagcctcatatttaaaatggggtgaatgagagcaactaatttagaacataactgtgaagattaaatgagacattatatgccaatcccttaagacagtgtcccaaacaaagtagtgctcaatgaaagttagctgttactctgaaccttcaatagatgcaggatctgatgacactttgcaatgttggttcaaaagccttggaaattcttgaggaaagtaagattcacacactcccccggggcagagagaacctaagttctaggattgctaaatttcactcaacaatcttcggacagcaccctgatttccaatgttttgttagtatgggattgtgtttgtttcatatttatgatattttacattttgtgaatttctctttgaatttcattcaaatatttgttactgtttcttaattaaagtgaaatgtttataacatgaaattaatcatttcaaagtggaccattcagtggcacttagtaccttcacagtgtactgcaactacctcctctatctagttccaaaatatttttcatcaccctaaaaggaggtctcatacccatgtataagttaattgccaatcaccctgcctacaaatccctcagaatcactaatctgttttctgtctctgtgtctctacttttctattctgaatatttcacatacatgcaatcatacaatagacgacattttatgtctggatttttccacttagtataagattgttgaggttcatccaagttttagcctgtatgagtatatcactccaaaatcctttttagggctgaataaagttccattctatggatatacggcaatttctttatccatcaactcttgatcaacatttgggctgtttccacctttatgccattgtgaatggtgctgctatgaatatgcatgtacatgaagatgtttgagtccctattttcaattcttcaccatatatacctaggagtggaattactggtttgtatggtaattctacgtttaacttgttgaggatgccaaacttataattctgttcatttgttgcagatcttcacagtggctgtaccattttacattcccaccagcaatgtataaggattccggttcttccacattctttccattgcttgttattttctcttttgtttttttggttggtggattggttggtaggttggttggttaattatagccatcctatatgggtgtgaagtgctatttcactgtggctttctttgacttgcattttcttattgactaatgaatgatgttgagcatctcttcatgtgtctgttatccacttgcatatcttctttgaagaaatgtctattcaagctctttgcctatttttaactgggctg

SEQ ID NO: 1583 - DNA, 1649 bp, Homo sapiens
aaggttgcagtgagccgagatcacaccacttcactccagcctgggcaacaaagcaagactgtctcaaaaaaaaaaaaaaaaaaagaaaagaaaagaaaagaaaaaagaaaaagaaaataaaaaaaagaaagaaggaggcacctggctactgtattccacctttctcctcacccactcttttttttttttttttttttgagacggagtccttctctgtcatccaggctggagtacagtggcaccatctcggctcactgcaacctccgcctcctgagttcaagctattctcctgcctcagcctcccaagtagctgggactacaaacacgcaccactacctccggctaatttttgtatttttagtagagatggggttttgccatgtttttcaggctagtcttgaactcctgacctcaagtggtccgcccgcctcagcctcccaaagtgctgggattacaggtgtgagccaccacgcccggccctcacccgctctttaaaatatccctaccagggtcaatggtttatctgtgcctcagtgttcccatctgtaaaatgaggataattttaaggattacctgagttagcatctgtgaaggggttagaatggtacctggcacatagtaggcactcaataaatggcatcactgatatggttccacggatggttgtattattaataggaataaagtgtgggatggaaaaacgttgctctgggcacctggaaccagccccaggggcacgtggggctctacacaggctctttaccccatgccagcgggaggacactttggggggaaactgaggcactgacaatcccctgccttcccagccctgagtccttctcacccatgcccagagcctcagaggccagcaaggtgccccaagggaaagcgacacttctgaactgcgctgcctggcacaattaccgttttcatcctcattaaactacattttcattctaattagagtttcaccgcctcccagagagaagggccgattacttttcagcatcattaacactggctccctccccactttcctcctcccctgcccaggctcccactacaccagggcattctctctctctctctccttcaccccatggaccagagagaagcaacagaacatttattgtcgcctactgggtgccaagttggatgctaggaaccttcccccacagcctcttcgccttatcttgggctggtctaattttctttttgtccccaacacttacccctttttgtttttgttttgttttgttttgttttgttttgttgagacagggtcttactctgtcgcccaggctggggtgcaggtgcgtgatctcggctcactgcaacctccgcctcccggattcaatcgattctcccacctcagcctcctgagtagctgggattacaggtgcacaccaccacctggctaatttttgtatttttttttagtagagagggagtttcaccaggttggccaggctggtctcaaactcctgatcccaagtgatccgcctgtcttggcctcccaaattgctgggattacaggtgtgagccactgcgcccggccccttttgaacatgctctatgctttatttgttctttttatcctctgtctccccctccccagaatgtcaacacccactcatgtcccccacgca

SEQ ID NO: 1584 - DNA, 2429 bp, Homo sapiens
ggctaaggcaggagaatcacttgaacctgggaggtggaagttgcagtgagctgagattgtgacattgcactccagcctgggctacaagagcaaaactccatttcaaaagaaagaaagaaaggaagaaaggaagaaagaaagaaagaaagaaagaaagaaagaaagaaagaaagaaagaaagaaagaaagaaggaaagaaaaagagagagaaagaaaggaaagaaaagaaagaaaagaaagaagggaagaaagaaagaaagagagagaaagaaagaaagaaaaagaaagaaagaaaaagaaagaaagaaagaaaaaagaaagaaagaaagaaggaaagaaaaagagaaagaaaggaaagaaaagaaagaaaagaaagaagggaagaaagaaagaaagagagagaaagaaagaaagaaaaagaaaagaaagaaagaaagaaagaaagaaagaaagaaagaaagaaagaaagaaagaaagaaaagaaagaaaatggataggactaaaccaacttaaaggtctttttggagtccaaagattctccaagtctcacccttctttccctgtccagaaaggctgattccagccaggtgtggtggctcatgcctgtaatcccagcactttgggaggctaaggtgggaggattgcttgagcccaggagttgaagaccaacctgggcaacatagggataccccatctctatgatttaaaagataaaaataaaaatgctggttcctgatggcccaaccttgcctgttcacaccagctctgggcctgtcccccatggaccaagctctggattccttgaaggccaccagtctccagcctccagtccagggtcactgttcctaagggcgtgcccagcctgaccagatcctcatgtgagggaggcacagggacaatgttccaggatgggcccttatgcctgctggtgatgtcagtgacaagcccagggctcagcctgcctctgtgtccttctccaggtgggtttgggcagcctggaccagagggtgcaatgagcttgtctgaccccatctgtgccgggagggcgggggcctgcattgtaagtctggccgtgggggccctcagtttctgtcctgtatttttacattctaattatttcatatatggccttctgatggactcatttactgggaagctaaagatacccttcaatgtctaaaaataaacctgaactgctaaaaattcagcatttctctccctcgcttccaccagctgggcctgtctgcttttactccaacaccatcaggagctacaaacaagatttacaaaagccagcaagtttacacgggcctgaatagcagattctcttttatcttcaatttgacaaaacattttggggttgttattattgaggctttcttttcttttctttctttctgtcctttgtttccttccttccttcctttttctttctttcttttctttctttctttctttctttcttcctcttcctcttctttcttcctttttctttctttctctttcttttctttctttcctttcttcttccctttattctttttttctatcacttcttctgctcctttagtctagtatttaggaaaactttcgtccaaatgcaagcttccaagatgttctccctctggtctgccacacctccttttcttacttcaattattttaagacactctcccaatttctatgagtaccatgcggatggcctgaaggccagttaagaataaacctgctaaaccaataaattacattcactcttatttccagaggaacgcttttacataaatatctgccatagaaataaatcagataaattaataagaactccctcctctcctcaaaccaaacagtgaacagtaatggttatcagaccagttaaaagaataaacctattaaataaataaatttgctctacgccaatttatgtcaccaatgtacttaaggggaaaccttttaaaagagtagatttacagtgcacacacagatctccactgggtatgtgtaattatgcataagaaagacattacttttaaagtggatgaatgggcgatacttttttgatttactgctagaaacagaaaaatggtaatggcatgaaataagcgtttgcaaacccatttcggaagacaggaaatgcttgatttacctagggcacccatcaggttctgtatttcagatcaaagtagataaatggtaaggcaaatggatatttggggggaaatctatagcctttctgtcaactctgcaagttaaatgtttggaataaaaacgcagagagtgtctatatgcaaggaagaagtcatgatttattagcaatcgggcaaatggaagtgggcagtgcttacctggaaggtgaggatttctcagatacgagggctgtgggctgtgtccacaattcctgatgtttttagctatgaaatctggtggccagc

SEQ ID NO: 1585 - DNA, 2091 bp, Homo sapiens
aggtcaggcctgagggcgtatagcttactggggacatcatcccagttgatgggggccgagggaggtgggcagaattgtctaaggagtcatataaaatgcagctctcaagtgtccatctggagaaacaaagtggggactcatttacccattggtgccgtccccctaggtcgaggtgacccccgagggcatggattcctctccatactcaggttgcccacatgtgctctgcaagagatctgggcatgggctgggtgagtgggtgagagggtctctcactgcccctggcccacgaggggtatccactgcagggggatgcggggtgatagtccatggagggtgagaagcagtgctgcttctgcctgctcaggggctcaggtgattttggaggagacgagacattccaggcagagaggtcatgcccacacgtcgtggctgtgtcagcgtctctgagatcagccccattccaaggtcccaggtggacgcggacacctgggagctggggcagcctttgaagatgtgcagcgtggagggcgcagccaggggctgagtggcctccgctcagtgtcgcccctgcagcagggctggccttttcaccttgctgccgtccctgcctccatttgcctccattcgtgggtggaagttatcagggccatgggtgccaacgccaggatgctggggcttccagattttgtttcactcggtggctcttagcaacatgtttcttgcattctgctcattctgtttcacatttcacacttccccaggctgagcgagccatccatctagtgcaaacgcttctgacagggctggggtggaggacgccctgctggccccagcaaggggaaggaagggggcttgctgggtgggtgtgggtggcgcatgctggtcaggacagcctggggtcgatgtccctgcacccccgccccccgcctccttccctgtcttgcagagccctcttggagctggcgattgctctgaacagaccttcctcctcttttcattccagtctctctgatcacctggggagatacagaccttgcaccttctccctcacagcccagacaccaccggaatcacctcacacaccacctgaatcaccaaacatctccaaacagccctcagacttttactctgcaggggcaatttttttaaaaaaaatttctcttcaaccttctcaaagcctctagtcagccacttagagaagaactctccaaatttcctatctctccctctatatttatattgatttacatttaaaattatttttgcacagggttttccttgattttctttctttggcaattacagattaatctgaacccctagatttttgagtatgtatctatgtctctatttatctatctatattttattttaaatctgtaataatattcagaattagctcacaaaactggattacacaaagccagcaggtttaaaaatatttcaaagatgttgcttttatgcttcaaatccttgaaaagccaaatacattcacttctgaaactaagtcttgggttttgctgaaaaaaaaaataagaaaagtgtttaatagcacatatggcataattttatttgacatctgttttgtaacaaacaatatttagctcacttatttgctgaatgatacagtacacagtgcaaacaaaaagtccaatgaacagtttttccagagtttgtaatatatcaatatttattgcaaaagaatgcaaaacttaaacatttaagtgtgttattgattgtaatatgcaaaacattgattactgtatgttgccactgcaaaaaaaaaagtgtactaaatgccttctggggtatgaaaatgaggtgcatttcagcaagaggagctcacttgctccctttggtgacatttagtcttaggcctgccccccttcccccgtttgtgtcatcctattgaagacagctgtcaatatatttaggatgctttagctcatagcagcaaaaatggtgagactattggcttaattgtgaggagtgattgattttaatggaaacaacatttaaaaactcagaatgcactttctgttggcagtgctaatagaatcctctaatgaattgaagcttcacacataa

SEQ ID NO: 1586 - DNA, 3493 bp, Homo sapiens
aagctggagggatgtatcaacgttagtttcctggctgtgatgccaaactatctatcattattcaggatattactattgggagaaactgggtgatgagtagacaagattcctcagttatttcttacaactgagtgtgaatctacaattatctcaagacaaaaagcttaaaaaaactcagcttttacttctttgttttatattgccatttccaccatactccttacagtttggtgttctgtggattctttactaatctgcctcgtttatttaaatgttaattggcgtctgttaatttgatttcagtactagaagccaaactcaacaataagaccccttaatgattacaaggtattagagcttggacaagggggtctgaaaagaccctcatccctacaagaaagtaaccagtgttcagaaataaataggcatgagagagatagaaggagagagagaaagagagaataccctaacagaaagaatgactgattggcaaatttaagagctcacaaaacagaccaggtctaggatgttagaaagtacaaacagaaaatagcccatgattttaaacattaattctttagtttctttttcccttttaaattttgaaataattatagattgataagaagttgcaaagatagtatggagaggtctttggttttccccattgcttgcatcttcgataactgtagtgctgcataatagcaaaagcaggaaaccaacatcactacaatgtacctggccacttctgtgtcatttgatcacgtctgtagattccgtaaccactgcctttattatgacacagaagtgctcttcaccacaagatctccctcatctacccatttccagttatatcccctccgtgccccaaccatccctagcccttggtgcctacccatctgtttaattttctcaatttgggaatgttgtataaatggaaccatatggtatatgacctttggcattggctttttctttttcttttttttttttaaattatagtttaagttatagggtacatgtgcagaatgtgcagttttgttacataggtatacacacgccatggtggtttgctgcacccatcaactcgtcacctgcatgagatatttctcctaatgctatccctcccctagcctcgcaatcccggacaggccccagtgtgtgatgttcccctccctgtgtccatgtgttctcattgttcagctcccacttatgagtgagaacatgcggtgtttggttttctgttcttctgttagtttgctgagaatgatggttttcagcttcatccatgtccctgcaaaggacatgatcatccatgtccctgcaaaggacatgaaattatccttttttatggctgcatagtattccatggtgtatatgtgccacattttctttatccagtctatcattgatgggcatttgggttggttccaagtctttgctattgtgaatagtgctgcaataaacatatgtgtgcatgtctctttatagtagaatgatttataatcctttgggtgtatatccagtagtgggattgctgggtcaaatgggatttctagttctagatccttgaggaatcgccacactgtcttccacaatgattgaactaatttacactcccaccaacagtgtaaaagcattcctatttctccacatgctctctaacgtgtgttgtttcctgactttttaatgattgccattctaactggcgtgagatggtatctcattgtggttttgatttgcatttctctgatgaccagtgatgatgagctttttttcatatgtttgtcagctgcataaatgtcttctttcgagaagtgtctgttcatatccttcacccactttttcatggggttgtttttttttcttgtaattttgtttaagttctttgtagattctgcctattagccctttgtcagatggatagattgcaaaaattttctcccattctgtaggttgcctgttcactctgatgatagtttcttttgctgtgcagaagctctttagtttaattagatcccatttgtcaattttggcttttgttgccattgcttttggtattttagacatgaagtctttgcccatgcttatgtcctgaatggtattgcctaggttttcttctaggatttttatggttttaggtcttaagtttaaatttttaatccatcttgagttaatttttgtataaggtataaggaaggagtccagtttcagttttctgcatatgtctagctagccagttttcccaacaccatttattaaataagaaatgttttttttttttttttttgagatggagttttgctctgtcacctagtcacccaggctggagtgcagtggtgtgatcttggcacactgcaatctccgcctcccgggttcaagcgattctcctgcctcagcctcccaagtagctgggattacaggcgcccaccaccatgcccagctcaattttgtatttgtggtagagacgggatttcaccatgttggttaggctggtcttgaactcctgacctcaagcagtccaccttcctaggcctcccaaactgctgggattacaggcgtgagccaccgcacccagccttggcattggctttttaaaattcagcataatgcccttgagcgccatctatgttttgcatgtattaagaattcattcctttatatttctgagtagcacctcatggcatagatgtaccacaattcatttcactattctcctattgtaggacttttttttttttccagaatttggctgttatagccaaaatttctgtgaacaatggcatacaggtttttgggtgaacgtaagtttatttttctaatataagggctcagaagtgcaattgttagatcgtatggtaagggtatgttttattttttattttttaagaaaatgtcaaagttttccagagtggctgtaccatcctacatttgtaccagcaatgcatgagagatcaggttgtttgcatcctcagcagcatttagtatcgtcattttgaacagaattttaactgttttaatcagtatgtagtgttatgttcctgaacatattttcatgtgtttatttgctattcatatctcttttttggtgaaatatctggccatgtcttttgcctgttttctaattatattatttattgagttgagttttgaggggttttgttttgttgttgagacaaggtctcactttgtcgcccaggctgcagtgcagtggtgctgtcatagctcattgcagccttcaactcctggcctcaagtgatcctcccacttcagcctcctaagtgagcagatgagactacaggtgtgagctaccatgcctggcctgagagttctttctacatattagatatgagtctttggtcagatacatggtttgcaaacattttcccctagtctgtagcttgtctttttatcttcttagcagggttttctgcagagcaaaaaatttaattttgacaaaatccaatttattaatttttccttttgtgaattt

SEQ ID NO: 1587 - DNA, 5177 bp, Homo sapiens
tcccctgtggtctgaggggtgagcaaatgacccagctaaaccactcacagttagtcctttggaaggccatattgattggtccaagtaggtcagctgagccaatcaatcagagtccttctggagaccacagtgattggtccaaggaatcagctgagccagtcagagttattcctaaggaacttctgactggagttggtgggaaaagcttctttcctctggcaaggcaagctcagaagacctgggatgaggtgtcagccttgtagagaagcgaatgctgagggaagtgagtcagggaggtaaagacagaaagtcctgagagtattgagtctcagactccagattccctgccccgtctgtgatttaacatgaaaacaagcccagaatcctgacagtgaataaacaccctgcctttttgttaaagctatccagaattggtttatatttctggaaagtaaagaaactgtaataggctgtgcttcccaggctagcctttgttatgtgtgtatattttttaatttagttgttcacatgtttaagtcatccctgtctatatgagagagaggaacatatcccatgcttccttcatttctctccctacacttggcacaatcttgggcacaaaatagatgctcactaaatacgtaggcccacagaggatgctagaattggctggtaggcccagctgcaaacaggaaaattctggatcacctagagtcagcctacaagagtgcccatcacaaatgtgcaggaatcgagtcacagagaattatggttttctcagtaaaggttgcttaaaacaaaagcccattcatctgcctgcagaagacatttaatcaatttacatgagggatttcaaaattagtcagactgtaatgaactatgaaatactgattaatgcatttttgcaatgtttgattagaaacttaacatgtatgcgagcacatctttaccattacagcatttctatgttaatatttggttcttaaccatcggcagaatagatattctgaattacagaaccaaagtgtatttgtggtgaacaatatatgcacagttttcctgctggaaagtgcttcttgatgttcaggaggtgtctcacatttgagggggtgagtgggaggaagtagttcatgggatgcagtcattatgaagttgagtatgagctgctaaattatttgagagttctccagaaaccactagggtaaaagaggccagccatgtctcccaccccagccctccgctaacaacaaggcattctctgaaagaggaaacaatcccaattttactaaggcagaagaagccaaattcttttggccagaatttaaatataccacctcagtcaaaaatgtttgttaggttcctcctcaggacaagcaaattattaattgaaacgcttgaaaatcttcttgaacctatagaggccacagttttaacacagttttaacgttctttccttctttctctctttctttctttttctgtctttctttttttttttttttttttttttttttgagacggagtctcgctctgtcacccaggctggagtgcagtggcgcaatctcggctcactgccagctccgcctcccgggttcacgccattctcctgcctcagcctcccgagcagctgggactgcaggtgcccgccaccacgcctggttaattttttttgtacttttagtagagacggggtttcactgtgttagccaggatggtcttgatttcctgaccttgtgatccgcctgtctcggcctcccaaagtgctgggattataggcatgagccaccacgcccggccctttcttctttctttctttctttctttcttccttttctttccttcctttctttctttctttccttactttctttctttctttctttctctttcctttcttctttcttccatccctccctcccttcctccctccctctctcccttccttccttccttccttctttccttccttccttccttccttctttctttgagatggggtctcactgtcttgcccagtctggagtgcagcagcataatctcttggcttactgcaacttccacctccaagactcaagccattcttccacctcagcctcccaagtagctgggactacaggtgtgcaccgccaaacctggctaattttttctatttttggtagagacagggtttcaccatgttgcccaggctggtcttgaactcctgggctcaagtgatctgcctgccttgacctcccaaagtgctgggattacaggcatgagccaccgctcccagcccacacttttaaatttctgaggacacctccaaagatttttgtgtctgtgtatttcacagagaaggcaagttagtctctttcgtataactggaatgccctttctcctggcaagatcaacagaactccaaacatcaggtgatgctggaagtcataaaaagggaaacatgctgaattgcaaaaatccaatcaactagaagtatgatcttcttaaagttacttaaatcttatttgcacacatgcggaaaacatctaaagaggtggattgacatttttaaaaaagatgtgttaaaaattagctattaaagaatttgaagataaattcccacagtaggtttctaagagcactgatatgctgagcctggccccagccataagattatctgacaaagcccaggcatggtggctcacgcctgtaatcccagcactttggaaggccgaagcgggcggatcaaaaccagcatggccaacatggtgaaaccccatcttaactaaaatacaaaaattagccaggcgtggtggtgcacacctgtaatcccacctacttgggaggctgaggcaggagaatcacttgaacccgggaggtggaggttgcagtgagctgagatcgccccactgctctccagcctggttgacagaactggactctgtctcaaaagaaaaaagattacctgacaaacactggtttcaaaaggtgctcctgtggaaatccaatcaccatagagtgtgctaactccagaacagcaatatacaaatttgttcacatacagaagaagaggtcacatatgtgagtgcacgcgtgggtacacacagagaaacatacttcatgattcttacaagtgcaggcaattatctcacatttagattttaagcctcccttagaattttaaaaatcattattttgcaggatcgccattattctgattcattagcaaggcatacttatgagggtcttaaaataaccaggatgctggacatgtaaaaacatgcttcttgctgtcatgacaactaaataacaacaataatgctcacatccgaatgactacagggaacaaagttattgtgcctgaatatagataagttaattatggaatcatcaaaagaacagcagctctgtcaatgcaaagatgattccaaaataatcaataacaacaatcttgtttggtaattggctatttgtttccaatatgggctctacctttggtctgcgtggaaatgcagcaggctctttagccagcagaagagaaaaaaaaaaaaaaggaaaatctttcagtttagggttggtggttgtcagtagcaacaaataatggaaaattgccatctggcttctttgtttaaatgagatttgaataatcaatttaataatggatagagcacttgcttacagaagtaatccattgtcattgctcagaaaaaataaaaactttgtcaccagagacaaagctctgcggtgtgactataggtaaagcaaataaacgtctacgtacatgccacaatttttattttcactgctgactttacataaactagaggataactcttccttctctatgcttagcttttcacattctgtgtttaataatcaggacaaaatctacagagcagttggcttgctacaggcattcaactccactgatggttagtggagaaagagacacacaaatggtagatttttttagcacattttcccccatcatcatgtgacatattgtggaacaggcctgatttcagcagagcagaggaaataaaaatgcatctggctatggggtgtgtgtgagtgtgagaatgtgtgtgtgtttcctttacacagctgcacagctgcaagaggaaaaatgctattcagaaaggaagaacagggtgacaccagggatcacgatgactcattcatttacatgataaaaatgaagatagcaggaaaggtgttcctaacccgagcagaagcaggagtgatgacatccaaatatggggcttctgtcatgtcgttttgcgtgtgtgtttgtgtgtgtgtttaatgaaacatgcatgtgcagtatcccattggcctcaaaagacccttgaatctttgactaaaaaatttactggtcaggcacagtggctcatgcctgtaatcccagcactttgggaggccaaggtgggtggatcacctgaggtcaggagtttcagaccagcctggccaacatgatgaaacccccgtctctattaaaaacccaaaaattagccaggcgtggtggcaggcgcctgtaatctcagctactcaggaggctgaggcgggagaattgcttgaacctgggaggcagaggttgcattgtgctgagattgtaccagtgcactacagcctgggccacagagtgagacccattctcaaaaaaaaaaaaaaaaaaaattccatgtgatttgaaggagaaaaagggatgaaatccaggccctgtcgcattttggaaagtggcattcaggattcaaacagcaccatctgggctctacggacctacgggactggaaggcgggggcttctcctggcctccactgcttgaagactagagggtattaagggaggatcatcctggtgaatctggccttaggctcctgtttccccagaactcccgatccactcggggcacattccctttcacccggcactggttttctcctcggcctgtgtcactcggaaataccccctgtgaggtttcaggttgtttgcctcttctctgactgaagactcattactgttcacctctgcccctctcccaacccaatccacttcttatttactctcccaggacatccaatgaccaggtccctccccaggtcacagtttcattaacccccttccttcaacagggaagttagatctggttgactctcatcccagagactccctctgggacccaacttggccccagggttacc

SEQ ID NO: 1588 - DNA, 1749 bp, Homo sapiens
ttaatgcaaggggaactggtggctttagaagaagggagacctgagcatagcacatttgacacactcagcccctcaccatgggacactctgtgccacctgaagactctgctgagagtccccaccagcaagaaggctctcaccagatgcagcccttcaaccttggacttctcatcctctagaactgtaagagacaattcccttttctttataaattacccagttattctgttctaagcaaccaaagacagatcaatacagaaacctcatctcaagctgttcatgcatggctgcagagaactcatcgagggcctagctggagccagaaatgcagggagagcccagagcctgcaaggagggagaaaggcactctccagcacaggcagacacagagctgaaagagcggagtagccaggggctgggtgccatgggcttcctggaggaggaggctcccagatctaggacagaactgaacaagtaaacagggtttggagaagccagggaggctggggtgggggggccagggggtgggcagggaagcaaaaggagaatcagcagggtggagggccctagattgtgccagacaggggccactccagctgctgcaggagtgacttcactcaccctcccggggttatgcacctgccacctcccagacatccccagccccgcatctccctgcacaatgcctgctctgattctccttgcagccagggtgagaggcagtcagcgaacaatgctatctgcacgtggtggcgcccaaaatacggctgtcatttatttcgttatatgaaattagagcacgccttgtagccataatgaatcatttccttcctgcctgggccacggtgtcaggcaggagctcggcatcccccattcagggcctttcacttcatcgcaggctaataataacccacgcgggtgaacacacatcttcccgagacaatggagggcctggatgggcattggggtcatgagtgcagtgcccacagcaggaggggagaagggccgggatggggcctgggctggacactgtggctgaaggaagacagtgcccatggggaggggaaggaaggcatctgggtgggcaccccaagtgggagctggggcacccaggtcccttttctagctgatcccctcaacaaggacaggaaatagctccctcccccaacccccagctattctaccaggattttttcccaatcatgcctaggtccagctcagaggccctaaccagagccctccacagctggcctcactcttcactcagcccccaattttcaaagcactggctccttccacagcttcatcccagccccatcctggcctggggatcccaggagccaccccctgcagcactgtctcacctcacatccctgcctcatgcaggctctgcagtagcaggtgctcagcaaatggatgagtgtgtcctgatggagccaagtccccgggtagctcccgctggggctatgacctgggagcttcatccggccctggacagcagatgcagacccaggtcctgccctatagggcccgccccaccccctaggttaaaggcaagtccagaccatgggaaaaccatcctcccagaccctgtgattattgttcgtctcttatcctgagtataacccataaggcattttattttattttattgagacaagctctcaattcatctcccagggtggagagcagtggcacactcaaagctcactgcagcctccaattcctgggctcaggtgatcctcctgc

SEQ ID NO: 1589 - DNA, 2997 bp, Homo sapiens
ggggttttgccatgttgaccagggtggtctctaactcctgaccacaggtgatctgcccacctcggcctcccaaaatgctggattacaggcatgagacacagcgccaagtctgtacatctatgctttatacataaaaatagtaatttttttcaacccccagggaccagttttttcccactggggggtcatattgccatagggaattcacccttgtatttaaatgaactggtttaatgaagatagttacaggaaaagctatttatttcaaacctcatttcctggtatcttgactgaacatccaaaagggtcaagagattgtgatgagaaacctgtgagaggaggctggatttgttacctctatcacgtggagaatcactaaagtacaacaaaatcaactcagtacagctagactccatctagctgttgggatagtttccatctcagagcttttggacctggacagttgcaatcaaacctgtggactttatgcataaggagtcctttgggttagctcatctctgtccaccagttgactcaggaaggtttgtggggagcacttgataagtgttagtgaaaatccagccctgcactagattagccataatttaaggcatgataaaatgtctgaattcgagagtgttagaaacacatccttttctggctgaaagtcctgcttacaacagggaaaaaaaaaaaaaaaaaaaagtcccaggcctgacaatatgccttggcatctattagtgggaaaaatctgctgctgagatttgtggacacatgtgtacatgcctgttttgcaggaaatgacattacagcagtccaaggaaacaaaccagaaggaccagccaaggacactgattctcggactaacatctagagaatcagcacatgtggcaaaagcttatgcaataaaacatcatcatctgctttaactgaataccttacctattcgtgtcctcattcaaaaatacacaacagttattctaaccatggaaatggaaaaaagtgtaggtggtaaccatggaaatgaagaaagtacagacaagtagaggtaagcagagaagcaggtgttaaagaagaaaatgaggccagacacagtgactcacccctgtgataccagcgctgggggatgccaaggcaggaggattgcttgaggccagaagtttgagaccaacctgggcgacatactgaaaccccacctctactaaaaattaaccgggtgcaggggctcacacctgtaatatcaacaatttgggaggccaaagtacgtggatcacctgtggtcaggagtttgagactagactgaccaacatggtgaaaccctgtctctaataaaaacacagaaaagttagtgaggcgtggtggtgcatgcctgtaatcccagctacttgggaggctgaggcaggagaatcacttgaactcaggagatggaggttgcagtgagctgagatcgcatcattgcactcggtctgatgacaagagtgcaatggatgacaagagagaaactctgtctcaaaaatagtaacaataataatttaaaagaaaatgaaacaaaaattccatatgtaaatactttgtgaactttacattttatagaatccttggatttgtgcacctacgctaatctgtctaaaaatttcactattttaaagcactacaaatctagttaatataaagttgaacaaaggaagagaaaaaacacaaacaatatttcataatgctttttctgaatgttcccggaccaaatcgagggtcaggctgcttattctcacagcccaataatgagacgcagatgaactgggaaaggagggagtttatttctgtaactggatacagggagaaggcctagaaattatccccagaccaactcaaaatcacagtgttccagagcttatataccttctaagctatatgtctgtgtgtaagtgtgcattcatctacagacataagtggtcgactttttctgatctctaactaagatctgagtcctgaagaccttcccctggagcctcagtaaatttatttaatctaaatgggtccaggtgctggggtgattacccttatcttgtttcctgctaaatcatggtttggggagttccttcagaccccaataaacttgcctgtggaggcctggggagtttcttcagacccccaataaaacctgtataatcccaaacgggtcctgtggaaaattcctcattatcttgtcatgcttcaaggcccaggaaaggccagggcagaactcttggtgggcttttgttacattccagcatttgtatagggcactggctctatcagcttttaatatttaacttcgccactcagtcagtactgaaacggttgtcatggaggcctgcattagtgagacctggcctgccacatgaagactcacagaggagaagccatctattgacaaacattttaaaggagggaaagaggaatccaatgtgatgtcagtgactgtgggactctggaatgatgcgagcatagaggaagctcatccctgacacttggcctgggttccctaagacccacgcatgccaagccaatctcagaggactgccatagacaggccccacctctgtggtctctgacatgagtcatacacagtgtgtgtaaaacaatccaatggaatgtatgcagaaaacactaggatttccacgtgtagtcactttgcttaaaaatatgtttatatgggctgggtgtggtgcctcatgcctgtaatcccaacattttggtaggccaaggctggaggatcacttgagctcaaaagttcaagactagcctaggcaacatggtgagaccttgcctcatttaaaaaaaaaaatgtttatatgtatacagaaagagaagacaaaatttttttctgataaaagtttggaggctgggcgcactggctcacgtctgtaatcccagcactttggggagaccaaggcaggcagatcacttgaagctaggagctcaagaccagcctggccaacatggtgaagccccatctct

SEQ ID NO: 1590 - DNA, 1593 bp, Homo sapiens
gataatatagccatctcctcaccctcctgtatggccatctcatggtgaagaaagctgttatcccagcaagtggccacaaaagcttggacggagctccttctcaagtaaaagactataactagttttcaatgagaagctttctttttctttttcttttcttttttttttttttttttttgagacagagtcttgctctgtcacccaggctggagtgtacagtggcgcgcgatcttggctcactgcaacctccccccttccagtttcaagtgatcctcctgcctcagcctcccgagtagctgggactacaggcacccaccaccacactctgctatttttgtattttttttagtagagatggggtttcaccatgttggccaggctggtctcgaactcctgatctcaggtgatccgcccccctcggcctcccaaagagctgggattataagcatgagccactgcacccggccagatttattttttaatggaccacactctgcttctgctccttgcatttcagtgagttccacggcaccgtttccatgatatcacgactgatccatgcaggatcacggctaataaatggctctaaaacaacctgtgaagacataaccattaagtgtgccaggtaccaatctgcaattccacatgctgcacatacagctctgaagcgcacgctccccacaagcccgccgtggctttctcagaggatcgggcatatggaaccataatggagcataaatttacagcaacagagatggacgagggagattaaagcttcatctgtaaggacatactgcatggcaaaaaaaaaaaaaagaaaaaagaaagaaagaaaaaagaaaacaacagttattgtagtttctgctttgtagtataatgagaaactcagtcgcttttgatagagtgtgggctccctctgctgcttgcaggagacaccaggactccgggcatttggggttccttggagatcagcgcagaggaggtggcctgaagtgggaagagaaagatggggctgagcgttgcagacggaccgactggttctgcaggctctgaccctgtgggcttctcagagtaattatgctgctgctgcaccaagaagcaagaaatggaaataacagaaaaacgcaaagaaactgtaagatgcactggccagatcacctgtgtgcacagaggaatgcatcacggaagcaatgcagcctgcccagagcagcttctccttccctccctccctcccttcctgtttaaatttttgcagagatggggtctcgttatgttgcccaggctggtctggaactcctggcttaaagcaatcctcccgcctcagcctctcgagtagctgggactacaagtgcaagccactgctcttccttccttccttccttccttctttcccttcctcccttcctttcttctcctttcgtccctccctcccttccttccttttccctccatccctgcctccctccttccctcccttcctacctaccaaccttccttccttcctccttccttgtttcctccctccttccctccctccctcattcatttcccagtcacaaggtaggactgcacttccccacccgctttgatgtt

SEQ ID NO: 1591 - DNA, 4759 bp, Homo sapiens
atggggagtggctgtaaatacagatgaagctttggcttgcttgcctaccactcactgtctgctgggtggcctggttcccaacaggccatggattggtaccagtctgtggcccagggactggggacccctgtcatagaacatgactactgtaaatgataagaatcagctgtaattggcttggggtcgtggagccactccaggaaggggtttcagtgttgtcagagtgagatgaggtggtgcctcgccaaggcatcttcagctggctttgggctcacttggcttggaaagttgacccccatctccaccctttcattttctgttgcaggctcttttctcatttctggagggtttgataggactgtggctatttgggatgtagcagaaggctaccggaagctctctttgaaggtacatgtggccagcatgagattgaggatctgaacttccctcccgagtccttcctgtgctcaatgctggttgctggggacacagctgtgagtgacacaggccttgatgcctctgtgggctgatgaaggacagacaggaagccagcaaacacaccaccgactgtgaggagtgaaatggagaaaccacaacagggtgacatgatggggacagaggcgggggacccatccacattgcatgggcagagcttcctggagaaggaggtgtttgagctgagaacagaaaggactacataagtggggatcttgaagaagaagggcagtccaggcagatggaacagctgatgcaaaaaccctgaggtgggagtgtctaagaacagcagaagttactgtgcaggcctgggcactgtggctcactcctgtaatcccagtactttgggaggctgaggtgggcggatcacctgaggtcaggagtttgagaccagcctggccaacatggtgaaacccccgtctctactaaaaatacaaaaatcagccgggtgtggtggtgcaaacctgtagtcccagctacttgggaggctgaggtgggaggatcgcttgaacccgggaggcggaggttgcactgggccaagattgtgccactgcactccagcctgggcgatagactgagattctgtctctaacaaaacaaaacaaaacaaaaaacagaaattaccttgaagagagacgcatgccctagtgaggcatgcacagaaagcttggggttccaaaatggggatgtcaactgaatgctctgggctacaagtgagaggatgagaggagccccaactcagagtggctctatgatacggggatgtgttatccaacacagcaagaacccacaattgcctcatgctgtgcccctgttcccccaaggggccccacaccccaggatttctgcatactccctggtttcacgatctcactgtcacctttggctgtgaatgcgtgcatccctgattcttggtctttctgttcccagggacacaaagtagacatgtgtccttgagcagcccatattcaggtccctggggctggtctatctgagctgtcttctcctaggacttggggagacaaagcgagtttcctcacagcaaataaacggattaaaatggaatgttaaacctctctgtgcttaaagtccctctgtcatctaggcacagtggctcatgcctgtaatcccagcactttgggaggctgaggctggaggatcattggaggtcaggagttcgagaccagcctggccaacatagtgaaacaccatctctactaaaaatacaaaaattagccaggtgtggtcatgcccacctgtagtcccagctacttgggaggctgaggcataagaatctctagagcctgggaggcagaggctgcagtgagctgagattgcaccactggactccagcctgggtgacagagccggttgttctattctctctcctcttctctcctctttctctgtgctcccatcctcaaattcctgtcctttaattacactaagcggtttaaccttccctctgattcctttttctctaaccacactatggcctcactttctgcctctttccatacggggaaggccaaagaaggacagagatgctggcataaagcccagacatcattcagtgtctgaggcagcaatggcagctatctgctctgagctgttttttttgtttgtttttttttgagacgggagtctcgctctgtcgcccaggctagagtgcagtggcatgatcttggctcactgcaagttccgcctcctgggttcacaccattctcctacctcagcctcctgagtagctgggactacaggtgcccaccaccatgcccggctaattttttttttttaaatttttattttttagtagagatggtgtttcaccatgttagccaggctggtctcgatctcctgacctcgtgatctatccgcctcggcctcccaaagtgctggcattacaggcatggagcaccgcgcccggcctgctctgagctcctatgtacccaaagaaaacaccccactccttctctgcttaagccacagtggatcgagtttgcagttattggaagcgaaaagccccctcacttacagggcctctgaggggtatttcctagaacaaagaatgcaaatgaaaacctgagaccagctgggaatataatatttctcccccaatcttgctaaacacccgagtactattttaaaaaaccatacacagtggcacacacatttgtagtcccagctactcgggaggctgaggcaggagaatcacttgagcccaggaggttgaggctgcagtgagctatgattgagctgctacactccagcctgggggacagagtaagaccctgtgtcaaataaaaataactaaataaataaatatagaatgggtagggcgcagtggctcatgcctgtaatcccagcactttgtgaggctgaggcaggtggatcacttgaggtcaggagttcgagaccagcctggccaacatggtgaaactccatctctattaaaaatacaaacattaggtggggtgtggtggctcacgcctgtaatcccagcactttgggaggccgaggcaggcagatcacgaagtcagaagatcgagaccatcctggctaacacagtgaaaccccgtctctactaaaaatacaaaaaattagccgggtgtggtggcgggcgcctgtagtcccagctactcgggaggctgaggcaggagaatggcgtgaacttgggaggcggagcttgcagtgagccgagatcacaccactgcactccagcctgggtgacagagcgagactccgtctcaaaaaaaaaaaaaattagctgggcatggtgatgggcacctgtaatcccagctacttggcaggctgaggctggataattgcttgaacccaggaggtgaaggttgcagtgagtggagattgcaccattgcactccagcctgggcgacaagagcaaaactctgtctcaaaacaaacaaacaaacaaaccccaaaaaacaacaacaacaaaaaaaatagaatgtacatatatcacatgtctttacactttgtattccaccctaaatgttgttgatgaaaccgaggaagtacaatgagctgctctgctctttccttttttttttttttttgagacagtctcactctgttgcccaggctggagtgcatgatcatgactcactgcagcctcaacctccccgggctccggtgactctcccaccttagcctcctgagtagttgggattacaggcgcatgccaccatgctcggctaatattttgtatttttagtagagatggggtttcactatgttgcccgggctggtctcaaactcctagactcaagcaatctgtccacctcaacctcccagagtactgagattacaggcatgagccactgcactcagccagctactcttaaatgtaagcaacactgggttcttgactttttgttgtttttttagatatgggacctcactctgttgcccaggctgaagtgcagtggtgcaatcatggctcactgcagcttccacctcctgggctcaggtgaccctcccgactcggcttcccaaaaggcaggttacaggtgtgagccactacacccagcttgtttttgttgttctttcaaaattattttctccacgttttcattaaaatttgatatttcttcagggccataatgactgggtgatggatgttgccattagcaacaacaagaaatggatcctgtctgcttccaaggtaaaagtggtcaagcttacaatatcgatcacgttcgccaggattggtgatagtggaagagttattgccaagtataaaattcctgggtgggttcggtgagctgtacctgaccgggccatcgtgttcacggagctgcctgggaatgtggacagcatgtccttctatgcgcaaacgcgatgagtttggagtttccaggtatttctgtgtctgtaccgttgacatttgaactttgttggaaaaagagtctggctggatcagtgagcaatggagccaatgggggacttgaagggaaagcatcaactcatggataagcctttgacactgcccaaggtccgggggggtctccctttcctgcagcactgcatcttgagattcccattccactggcacatagcagccagcccaggatatcccaacagctgtcctgcaggtgtgaaccccggagaagtggggacctactccgccctccacccatattagagcagcagtccccaacctttttggcaccagggaccagtttcgtggaagacaattattccatggttggggggcgggggatggttttgggatggtgcaagagca

SEQ ID NO: 1592 - DNA, 3844 bp, Homo sapiens
ccacaccaaaggcttcctcttaaccctcacacctggatcctgtataagcatgtctgtctgctctgactttagcccagatggtaactcctcggcagctgtaaacatccgaacactctcatagtcaacaaaacaacagagcaggaaggctacagcccagcacaccaggaggctcatgccaaggcacggaggtctgtactggtcactctgcttccaggaggctcgtgccaaggcacagaggtctgtactggtcactccgcttccaggaagcttgtgccaaggcacggaggtctgtacttgtcactctgcttaaatgcaataggttgaagtacaaccagtcataagaaacattctttccctttgtcctctaatttttaatttttgaaaattcacatgcactataattcacttctttggtttacaattcagtgagtttttccacatgcacagcttcttgtgtccacccccacagtccgcgggcagaagcattccaactctcctgtgctctccccacctcaatctgtagcagccatggatttattctgtgttcctacagttgtgcttctccaagaatgtcacatcaacgggctgatatagtaggcagccctttgtggctgcattctctcacataccgtaatgtactcagaattcaattcgtgggggtgtatgtaccaacacacaatcctctctcttgctgagtagtattccatcctgtggatgtgccacggtctgcttatccagtcactcactgaaggataactgggcgtttgtgattatgaagagtactgtgttctgcagcgggcaggcctatgcaaacagacctccaagtcagaggaagctgagaggccaagaggctgacaaatccagtttctcagaaagaaacatttactaggggcttatgaacacaagtcacatctgtgtttcaggtggcgttgagaagagatggtggatccctgtgctgcgccttcccagacacagggctcatagaccataggaaaggaatgcagtggatacttggagttgactccttggggaaaggcaagaatgtcatgtgaatctgcctgagggcaggattaatggtcaagattgttttgacctaagggcaggatttaaggtaagtgcaatgctcttccacaaggaacagttgatgaaatagaaatcttaaaggcattcccgggactggggtgaatcacaagccaacatgcagatcaacatccgagtgggagctgcgccagcctccgggtactgctttaaacactcatggacaattctatgtgaacatcgattttatttctttagggtaataccaaggagtcagagtgctgggggataaagtaactgtatgtataatgttttacaaaactgctaaatggctttccagagaggccagactcttttgcattctcagctgcaataaatgagcatccttgttgccacatcctcaccaacacttggtattgttgatctatctatccatatatacacatatatatatatatattttttattgttgttgttgttgtttcagatggagtctcactctgtcacccaggctggagtgcaatggcacaatcttggctcactgcaacctctgcctcccagattccagccattctcctgcctcagcctcccaagtagctggactacaggtgcccgccaacacgcctggttcaattttttgtatttttagtagagacggggtttcactgtgtcagccagaatggtcttgatctcctgacctcatgatccacccacctcagcccctcaaagtgctgggattacaggcatgagcaccgcacccagccgatatttttaattttgtccattctattagatgttaatggcctctcctcatggttttgctttttttatttaaacagtttttaggtacaggtggtttttggttacatgaataagttcttcaatggtgacttctgagattttggtgcacctgtcacctaagcagtgtacagtggacccaatatgtagtctttcatccctcactcccctcccaaccttccccactagttcccagggtccattatttcattcttatgcctttgcatcctcattgcttagctcccatttatgagtgagaacatacaatatttggtttcccactcctgagttacttcactcagaataatggcccccagctccatccaagttgctgcaaaggccattattaccttctgttttatggctgagtagtatccatggtgtatatattggtgtgcatatactacattttctttatccacttattgattgatggacacttaggttggttccttatgtttgcaattgtgaattgtgctgctataaacatgcatgtgcaggtgtctttttcacagaatgacttcttttcctgtgggtagatacccagtagtgggattgctggatcaaatggtggatctacatttagttctttaaggaatctcctcactgttttccatcgtggttgtactagtttgcattcccaccagcagattgccattcccctactgctcatgatattgggtgtcccgttgcttgatttttgtagatcttctgtagctcttctccagtaaagcatctgttcagatgtcctcctgagacactgaccttcttattctctagcactcttccttactccacctgcaattaaaatccctggtgatctggactcccttaccctagagtttagccaagcccctatgcaggatttctataactttaccgttcatgttttctatggctgggcactggagatgacacgtagatcccaatggtaaaatccagttcagtaaaaaggatcccttgaatgtatctggaagtttctccagtgccagggtgagtgctgcaactggaaggacaccccgggaccactaggagaggacaaggtcaccgatgagaccgataagactgccagcagcaaacattcccaaactgggggcaaaggtttcatgggcaggctcactccctgaccacatgcccagtgctggtcatgcagttgggactgagattgtcatagcgatgggaagactaccctgggcgatcattatgaaaagccttctgtgggaggaggctgtggtttttgttttcttaacctgcatatgcatgcgccaaattgctttggctttaggaaagctcactgcctgtgtgatgggggtaggggaagcaatttttaaaaaatactaaaactgattacatctgtttattccttttcagaaagtggatgaattaatttcagctgtggattttttcaatttaggaaaaattgtaaatggaccttttagctatgaaaggtaaaggcccattgacattttccatgggagaggttaagacagagtgaaattgctctgcctaaaaagtaatgcaaaagttcaggtaccagtggcctcctgaaagaaatgggcaggcatcctggggctccagcagagaagactggaggcagggcttgctggagagactgaagaccagtcccccagcaaggcagtggaggggtctggaggaagggggcagggccagggaagcatcccggggcggaggcagatgtccaagagacggggctgacagcgacgcctggtgctccacgccccaggctgcagtcacccagtgttacccacaaaccaccattccatggcctgtgctcccacttgcacaaaagtcacaggttccagggatcaggatgtggacatctttgggagccattattctgccccctacacctaataacacgaatgtcttagaaaatggcaaatacacaatgtgcctaactgacagcggggttcctggggaaggatggtaatattttgtcaaaaggctcattccagaccaataatcctacagcccacggagaaaacga

SEQ ID NO: 1593 - DNA, 2152 bp, Homo sapiens
ctcccgggttcaagggcttctcttgcctcaacctcctgagtagctgggactacaggcgtgcaccaccacacccagataatttttgtatttttagtagagagggggtttcatgatgttgcccaggctggactcgagtgatctgcccgccttggcctcccaaagtgctgggatgacaggcttaagccacggcaccaggccagagatgtttactaagtgcttaaatgtgccaagtcctgtcccaagaattctgcatgcgacggcacaatccctccagccaccttgtgtgtggtactagtgctagctccatctttgaaaggagaaaactcacaccaagaaaggtgaagtcacgagttcagagtcacacagtcagtgtgcatagttgcaggacccaaatccaggcagtctggcatgagagacacactcctgaccaagaccaggaaggggcaaagccagggttcaaagccaggaacgttgaccacagtgcacatttactcagctgatgcaattgcttgactgcaggttatggaatggtcaggtcagcccacaccagatatgctcaacacacctaatggtacatttgcctaaaatttatccttagtatttcatagcagaagagaatggtttcagtctttttaaaggtttttgtatttttttaactgaccttattccaactgtttctttaaaaatatattgaggccgggcgcggtggctcacgcctgtaatcctagcattttgggaggccaaggcgggtggatcacgaggtcaggagatcgaaaccatcctggctaacacagtgaaaccccatctctactaaaaatacaagaaaattagccgggcatggtggcacacgcctgtagtcccagctactcaggaggctgaggcaggagactcacttgaacccaggaagcggaggttaaaggattttttcgtgatccttgaacacatagcacttcgtggatgatttattaaatgtatcctctttgattattcttgcacttttttcctagtctgtctgtctgtctttttgccggtatctccctctccatctgtctctccttccctgtctgtctctctgtctctgtccctttggctttttcatctgtctctctatctctctcagtctatctctgtatctctatctctcctttgcctctctctcctttcacatactttctgaattctaaggattcaattaaacaaagaaattgttgctctgggccagtttctggtaagtgaagcttgtggattttcgcagggtgtgaaaatgtatgaaggaggtgtcacacttttttagctttttttgtcatttatttttcacaaagtctaaatcacaaaataacacttcatcataaaattttaattaacacacacttccctctggctttcagcaatttttttcatattaaaagtaatacatattcataaaaatttggaaagcaaaagagaaaaatcacctatgattctaccacccacctacaaactgttaatgtattttacttccaaatccttaatgcctgtttgctttttgaaaaacagttctggttaaatattgcaaatagtcattaatgccctgctcttttcatattgcattgtattttaaatatttttataagctcctcacaaacatcattttaatagatatttaaataaatagaatttaacagatctttaaataaatatatggtgacctatgttttcttttaggtagttatcagcttattgctattaaaaataacactaaacttttgtttatctacagagtgtcaggtaagcaagtgaacattttgatgcaaaaagaaatcactttttttcctctggattttggacttttgttagactgtatcacaaaagtgaaattcttgggccaggcgcagtggctcacgcctgtaatcccagcactttgggaggccgaggcaggtggatcacgaggtcaggagatggagaccatcctagctaacacagtgaaaccccatctctactaaaaatacaaaaaaattagccgggcgtggcggcatgcgcctgtagtcccagctactcaggaggctgaggcaggagaaaggcgtgaacccaggaggcagagcttgcagtgagccgagatcgcgccactgcactccagcctgggcaacagagagagactcttgtctaaaaaaac

SEQ ID NO: 1594 - DNA, 1916 bp, Homo sapiens
gcaaagcaactgtgggaattgctagcatggcatttatatttacagtcatctctctgatcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaacttaccattaacaaagaagcgtcatgtaatgtcttccatctctaaaaacaaaaccaaaaaaaacccatctgtccacctcactcacatctccctccatctgtcattcctttcctctgcatcccttaatgttaaaagtccccacgaaaggacccagtgtctcactgtcctttttctatctttatttcactccatttaggctttctcacccatattcaactgaaaatactcttggaaaggtcaccagtagccaccgtcttgtcaaatctggtttcacttctctgtctcatccttcttaagtctgtaggcagtatttgattgaattgattgctccctccttgaaaaactctgctcttggcttctatgacactacattcttagattaacctctcacctcatggctactgcttatgggtcagtttagcttttaacagaatgtaaatccagttatatatctcctctgttcaaagcccttcgatgacatagtgtttctcatcacactcagaattaaatccacaatcattacaatggactcccaagtcctaagtctgctggcttttgcccacctctctggcatcttatattgaactggcctttgtgctgtttcttgaacctgccaagctcctgagagctaccatgcttgctgttcccagtgtctagaaagctcttcacccagatctttgcgtggttcacttcacgttatttagagctctgcttgtatattacttcctcagagagaccttcccagaccactgtatcactgctccccaacctgtcactttctctctccccaccctgctttttattcctcatagcacttgtccctgtctaaaattaagtattgacttgtttataaacagtgtcttccttcctccccacagaatggaagctttctatcacttgtctccttgaacacttctctgttcctagtgtctcaaacaatggcatgcaattgctggcccacagatatttgaatgaatgctgctaaaaggttgaatcagatgaggatgggaatgttcctgttggatttggcaatatgccatttgttggtgttctggctgagcagtttaaacagagcactgagggtgggagtcagggcaaatagattaaggagaacctgaaggtaaggaattagacaagacgaattagacaactgtgtttcggaaagtcagctgagaagagagacgcgaggctggtggtagctgggggagggtaaatgaggtcaagaagacaagtctttgagttgacagcagtggatgtaatccagagcacacatgacaggatggaagagacttgtcttcccttttagcaggtaggaaaatggtgaagatagttaccaagccactctgatggtgtagttcatggagtcgggtggagggtgagagtggaggcggatgagtcagtgcctggccagctgcatgagaaaacaaggctaggtattgggtgaaagggagccaggccctgtggaatgaggtgggattgccatgtcttcaaaccagatgttgccatggttggggtcctggcaaaaggtgactaagggagcagggtgtggaaagaggaaaaaagaagcaaccagcagttttgttacatggtggctgaggatctaataat

SEQ ID NO: 1595 - DNA, 3739 bp, Homo sapiens
gagcatcagggtgtcctccctaaaagcaccaactggactcagcaaaaacagctgaattccactgcaaacaactctttgacttaaacaagattattctgagaaatcacaaaacaaaagccctttttaaaatcagggcttcctgagagtccaggggaattggaattgtgtgattccagtggcaactggcagataggttgaggaaggccatcttggaccttgcagccttgctgactctccagctggatgcagtcccatgagtggggcccaaacaaaactgtcagaggatcaacctagacaactccaggaattatgggatatgataaactgttgttgttttaggctgctaagtatagaggtaatttgttacacataaatagttaagtagtttactctcactaccactagaacggtcagacttacctgggcaggcaacaatggaatttagaacaatcctgtggtcctagaggcccccaagccagaaagcagcacctgcccgacgcctgctctttctcttttagttatgttacagaagtagtttacaaatgtctggtgatccttttattccccagaggcaattggactcagcaaaaacagctgaattccactgcaaacaactctttgacttaaacaagattattctaagaaatcacaaaccaaaagccctttttaaaatcagggcttcctgagagtccaggggaattggaattgtgtgattccactgtatgacgctcagtacagtggctgtagcgccataaggtcacctgcccaggttgctttggaggaaaactgcttttgatttcaccagcaggtgagcagactggatcactttggtgacttgaatgtcttgggatgctatcaggccatccttctgctgttaagaagtgctgcctggacagcacagttatcacaaaaagaaatccttatccattttttccctgggattaagcctgctctcttaatcagtatgcagagtgaaaacccactgggacatgagggacagctctgtcaccctgctgtactgcctggtaaaattccactagcttgtcaagatccagcaacagcattgcttcctctgggcaaacatcacttgctttcattccactcccccatgtggtagaacaataatgccagggactgctatctttaacactgttgtacatcatgagtacactgccttagggttgtctgtgcctccatcccactgactcaggctcactttaagaggaaggattttgctgtaactgtcttgatacatccagtgtgcacctgacacatggaagacattgggtaaatagctgctgaattaattcattcagcaactatttatcaaattcctactttgtgccaggtacttgctctggtgtcaccgcaggaaacaaaacacacaaattcttgccttcagagatcctaatttccactcaaaggagtcaaaggatacacagaaaataataaataaattgtagggtatattataggttatatgagaagataacaaatattatacagaataataaagcaggaaaagagaaagaggaacagcagttttaatagaagcttgcatttgagcaaagacttgtaggcatagaggaatttagccaagtggatctggggaaaaagtgtcctaggctcaagacacagtcagtgcaaaggtcctggggtaggggtatgcctgatttatttgaagaacagcaaagaggccacagtggctgtagccatgtgaacagggagcacctgttacaagataaaaatagaactggtaatggtgtcgggtgctgtttgtgtaggaatttgtaggacagagtaagaattttagcagaggagtgacacaacctaatataggctttaaaaggacccattagactattcaattcagtaaaaataaaaagaactcgtaggaaggtttgagtggaagcagttaggaggcaacaatgacaacccaggtgagagaagatggtggcttgcaccaggggaagcaatgggggtggtgaaaagtagtcaggctctggatatattctgaatagtcttttctaacagattaggtgtgttgtgagaaagaaggagaagttgtgaagagtcaagggtaactccaagatttttggcctgaggaacagagagaggacttactattggtcaaggtgaaaagaacagaggtggatctggttttggaagagatcacaaggccatgtttggaaacgctgagtttgatatttctactagcaagacattgaggagatggtgggatatttgagtctgaaatccatggagaatgtgtgggctagaggcataaatttgaaggaactaataaacttgagcacattactctcttgattttatctcctcaacagtaaattgaggtggcgggagaggatattaggcaagatattcgaataaatgattatctgcaattctttcctgtgctaacatcaggcatttatctgaaagacaattcagcatcccacattgctcacctctggcattctgcctttgctggcctctccgcttgtaattccatttttcaggcttctgtgagacatcactcaaatgagagcccagatgtgacagcagagccagctggtggcaatggatggtgacacagctcttagatacactgggctactggctgtaaagagggcaaagcaggcaaaggaagatacaactgctttatcacgaaacggcagacccagagatagcaacggctgcagagggcaggcatgaggctgccctctttgcaaaagaagccagtgctgtccaccaggcagtgccacaaatggcattgttctttccaacactgagcaggaggctctttgcaggattactttagaagcaggataaatatatgccttgctttgcccaggacagtctgaattggcatcatttattccagtgtaattgttaacagcagcttctttcactttcaaaattatcccagttcgaatgataaattacatgatcgctcatcttataagcttgcctcttcacatctttttcccagaaaagccctagcgtggtctttccctcacgacccagaactttctgacttttgatcagttatgaattgactcaatgtccatgggccaaccctggaaacatagcaaaagctccaaattttcttcttgctgcttccaattcccaacccactgaaaagcgagggacccaggctttgcttcaatggagcgaggatccattgaaggacccagacaatgatttctgcatgtgactctacttaagaatcattggggccactgtcgctttcttggctcctgaacttaccttttctgcatctaagcctcacaagaaccttgtagccaatagtgtaaaatggctcgggtcacctacacagcagggatttgaccacactgcctggttctacattcattcatatcattgcttattaataagctctctttggctgggcatggtggctcatgcctgtaatcccagcactttgggaagcagaagcaggtggatcacctgaggtcaggagttcgagaccagcttggccaacatggtgagccccatctctactaaaaatacaaaaattagccaggcgtgatggtaggcacctgtaatcccagctactcaggaggctgaggcaggagaatcgcttgaacttgggaggcggaggttgcagtgagtcgagatcacaccactgcactccagcctcagcaatagagggagatttcatctcaaaaaaaaaaaaaaaaaaaaaaaaaaagagagaaagaaaatgaaaaaacct

SEQ ID NO: 1596 - DNA, 6962 bp, Homo sapiens
aaaaagaatcattggataaaatactttttaaaatctgagaatttccctaatggaatgatctgtactcttcatttttattttctgtgaacaagagctcagtgtgcccatcagtagagctggctttgacagtgtcacgtgtgcacagccacaaatgctacactgagcactgggcattcggatggaaacctaccatctgaggattgtttctagaaacaggttttgtgtttgacagtcggcatgccctccgtcacttgttcttccagccttagaaagcatatttcttatcccttttgacaaagcaggaaactgaggcttagagtacataagcagcagaggcaggacttgaattcaagtttggtaatgaaatctctgctgccaaccactacaactgttgctactagtgagctgcaaggtctcaaggaggtaatcagttctgagttttaatatctaaagtgacattttaactgagcacctactttttaaaaattgaacacagtgtcacgaactgtgctaggcaagaggctacaacagtctgtaagagagatgtggtccctgtccccaccaggctcccggtctgtaagtgacagtcagtgtgtcacacatgagcatggggtactgaccccagaatttggtagtacctaggatcaaggcaagcttcctgaagaagcatatatctaatctgagtcattctttctcttgcatgatatagaaactcaaggaaagctaataaaatcagctttgggcttgctataggagaggtggcaagacatgaagctcaagaggacaacagaagctggacagtgaagagccttggatgttatgttaatgactctgaacttgatcttaaaggaggtggcagaaaaatgtcttgggccagggctgttgaagaacacatactcttggtgttttgtagaaaatagatgggtgggggagcaatatgagaaggcagagacaagttagtggtagcaacttaagcaggagatggcagagcaggacccatgacaactgtttgccttgatcctaggtactaccaaattctgggctcagaaccccatgctcatgtgtgacacactgactgtcacttactgatcaggagcttggtggggacagggaccacatttctcttacagactgttgcagcctcttgcctagcacagtacctgacactgtgctcaatttttaaaaagtaggtgctcagttggccaggcacggtggctcacacctgtaatcccaacactttgggaggctgaggcaggcggatcacctgaagtcagaagtttgagaccaacctggccaacacggtgaaaccccgtctctactaaaaatacaaaaattagccaggcgtggtggtgggcacctgtaatcccagctactcgggaggctgaggcaggagaatggcttgaacccaggaggtggaggttgcagtgagctgaaatcttgccactctactccagactgggggacaagagcgtaactctgtctcaaaaaaaaaaaaaagtaggtactcagttaaaatgtcacattagatattaaaactcagaaatgtattatcctggtgagaggataaagaagtgaagctctctcctgacactcagcaggttgaactgacaaaacttggcaactggtggcattttggtaggggtggtaaagagaaagaaaaagtcaaagatgaccctcgggtttctgtccaagtcctataggggggcaggaaggcagaacataactacaaagagactgagcccagagatcagcaggtctgaatacaaattctagtgttctgagaccatgaacaagttatttaaccttggatgcttcattgctgtaaaggctgaagaatgtaacaggccccacctcaaagggctgtagccaggatcaagtgagacacgacaagtaagatgcctgcctggcacctggacacatcgagggctgagtgttgcctcgcattgctgtggttcactgagatgagaagagcagtggggaaggaggggcctggggagtggcagctgtagcagtgctggtgctcaaggtgggagaggccagggcagtggttgacactcaccaaagctaacaaccacgggggactcactccatacctggcactgttctaggtactgtgaatttaattctcacaatgaccctgtgaggtcactgttcccatttcacacatgagaaatggcaatgttactagtaactggcagaatcaggtttgattctagagcccacaattttaatctcttctctgtcctgctttcaagctaagctcagttttacacttatagaatccaatgtttacaaagggtcatccaactgagacgtccagcaggcagcacgaaacattcaacgagctggtatgcaggcccttatcaaggctgaaggtatggacttggccttcactggcatgttgacaagaactgaagccccaagagtgggtgaggttacccaggacacacgtgtagaaggagaataaaggagcttgctgcaaagtcagaaagattacagacttcacagtgacgggcagagataaatggccctctaatgaggctgggagtgagcagttagagactcagagaaaaatctggaaagggcagagggaagagggtatctaaagaaagagaaagagatcagtagcatggaataacccaggaatgccaagtaaaatgcagagcccaaggagcacccaatgaccttcatgacgtggaggttcatcttggagagacctttgctgggctggggctggggctggactgcagaggtctgatgagtgagtgagaggaacctggagatggtgaatgtaaatacagtagagcgctttcttggtaggtttagttgtaaaggggaggtggtggttttgggagaatgggtgctcattttaacagatgaaatagacttgtgcctatttaaatccttgtatcaacaagcaggagacagagagattgagtgaaaaaatgggaagaggctgggaatatctgatagacagagaggtctctgagcgggcaggaaaggaaagggtagcgccatagctgagagcaagggttcaggcatgggtgcagcccagaccaaattctggctcctatatgaccaagggacaatctctcaaccttcctacacctcaattacctcatctgaacacaggctcaaaaataatcctagtcctcagtgggtgagaggatccaatgagggtactcacaaccactgttaacttagttaataaatactagctattaatcctatagcatccatagtacaggtaggggcagttagtctgagaaaggcaaaaggggagttttttcattgggacaggaagaagaagaaaaggatgaatgcaaagcagacatgggattcaaaggtgttgctctcttaggactcctgtgttctatatggagtcaggaacaagctcctctgcctaatgactcctcttcataagagtgaggagaaataatagcagggttagaagtaaaagagtcaggaacattatttgtaataatgaaggggccggtgggcaagagaactgatggaggaaatgagcagaaagggctggctgggcatcattcaagcttagagactattaatttacaggggcactgatctctgtgttgatgtggttttctcggttgcactgagcttagatgtctaggtataggcttagggtggggagatagctcaatggttctagaatcaatgagactcacataagtggaagaacagaaggatcatctgatgatctgggaagtggatggctcaagtgctggagatgagggacttaattggatagggaagtaagtggcgacaagacaaggcttacaggaaaagaaatcaaagaaagtctccatgctgaagaagggagtgctatttaagtaactagattgcaagatgagttagtttcaaagaatcactgaagataacatcacgacttagaatgatgaaaggcttagaaggaaatgtctggaaggggaggagaaggcaactgtacggacagtcaaagagtgcgaaaggcaaaaagtgggacaggcagcggtcccaagtgaggctcataagtgctccagcaggcagaggaagggtggtctggagcagcttggaggaggatctaagagtctctggattggtgaaatcataggtcctcctcaggcgaagccttcactttagagtgtctgattgggatggagaaggggaagtacgtgtattaagggaagttgtcaagatcaggcgcttgaggctgttgctctggcctctgaaggtagtactgtaaagtactgagtcagaaatcagagagagattctcattttaattcttaatgaagacttgtgattttctttctgtgaccagtctctaaataggtagaaactttggttgttttctactgaaagcaaaatgcctttagtaaataatgatacctgtttcctcaaaaataagagtaacatttaaaagacaaacaaaaaatgccgtaaagatgtttggtcttaaatcacaaacagtatgaggggagagtcattccaaagttagagagatttttagatatgcagtgatatgagttgctgctcacactggatcatttctgttaaatattacatatttactaatcatactccaaaatgcacctatttccataatcaatgataattatttgggatagtaaaactcagtagaatgtaaaatataaatgtgagtgtgtcattatcaaggagagaacatcaagaataattgtatttgaaggtggctttattttaaatatgtgtaattcattatcttactttactggaattatcatggccccccattctaatttcccaaatgttataattaaaaggaaaccacaaagaatgtaatttttgcaggtgtttttaacatttttaaatgacacttggaagtatacttactgtgttaagtccaacaaaaaaagcatagcatacaacctatttttttttttaaatcagagatagccttttcttttacattaaaagagatctaccatttttaggtataactgcacatacttcaattaatcttcctgttatcatcggcaataaaaaaatgagggggtgggaatttctcagcttataccataaagaaggagggagggagaaagaagggaggagagagaagtgaggaagatttaaatgaactgaaagcataaatacctgcatccttgtgtgtcttcatggtgattcgtgttgtacctatgatgtcgtttcagtttctaaacagagtatgactgcccaggtccagtcaatgcttgagcaggcagctgcagtgcgggtagatagggagggtaacggaagctgagtccagcccacaacatgcacggaagggagaccccctggcaacagaggcggtctccctatgggacagtcatattggtaaagttcctggcatggatattactctattatctcagtgggcacatgatcagacaaggaaaaacttcttggtcaatgcgtaggcctggctttttcctaggtgacttttaggctactgtcaaatatagggattacttcatgggcatgtgacccatgcagctgcacagggccctgtgctcagacaggtcccatatttgattctctgctgtggccatcttgaaattcttaatgatattagaacaagaggcccaactttcaatatgtactgaactctgcaaattatgcagctagttctgatcaagcatatgtcatctttgaaagaactcctggccttttgcctggaatgctcggtagtattcctcagtccagagaaccagaaaaggactagaactcaatggacggtgtttcacctttccctgatgcttcactagggtttagttccgactacagagggttcttcaatggtttagacaaaaaatgattgaccttttcaccacactaccatcccctaggaaacttcagccttctcaagcacctcacaactgagcaaatcccatggagactaggggatcttaaagactaaagagaatgtttgaatttgggtgaaggggtttgtgcttgtcctatccaatcttcttcctagccttgtgaacctaacattctagatgttccttgaaggctaagcagaaagcagttatttcacccagggtaggctctgggagactgatgaaaagaagaacccagccatccatcaggtttccagctcttcatggaaaggccttgaagtctttcctgtgtgaattagctctcaggtaaactttcattagaaaggtaggaatagctgttttgtagagacaattagaatttctacactactcactcccactcacccttttttcaaatcattgtcagggtatcccacagtaggcggacttacataaaattacaattcgaggggtgtgtatcaagatgggggtgggatacaagaagtctcacaatgcaatttattctagaaggttgtgaaattaaaccctcttaagtaaacgtcagagtttataacttaaaaattcaaaacactctgggaatggttttctaataaatttccaaattgctggtctagaaggtactcactaaagactttccaaggagccagtcttaagccttttgcattgcaaatggaaagtgccctaagaaaaaaggattggttttttaaaaaataataaaatttgatatcataagcattttcactaagtttctccccggcctatttctcatagcaatggtataacttgctctgaaaatgacagctaggaccatagatgtgaaacccagaggctttcctaatcaagccagaggatcacaggcagtctgactggatagacacttgaaatagatcatacaatgaactcgtacacaccccacctcccctgcccctccatcctattttacaggccagaagaatgaggcccatagagtgtgagagagagggcccaggtgaactccttttaagagtctggactcaagcccacctcttccaactcctcatccattcttctacccaggctggaattctatctcaccttctcaaccaaaccatggtacttttta

SEQ ID NO: 1597 - DNA, 2619 bp, Homo sapiens
cgcacattcctacataaatacacacatatttgcaaaatctctacatgaattatcttatataattcaccaactaaatgtaaaagaaaaaatcacttgtaggtcttccaacaggaatccaaaacacatgtttacatatatgcttaacattcatttaatcatgcattcagtcacatcacatattaagttctaaatagccaaggctgaagaaagtagttctatctctcctctcacttaaaaaaaaaaaaattatatgtggaattcttagtgaatagacaaataattccttctttatttctctttcttctcttttcttcctgaacacaagaaatttctaagagaagacagaaccaagcccttgcctgtcttgttccatatcccgtgtctcagaccctgcctggcatgtggtaggcacaaaaaagttacttgttaaacaaataatgcaatagtgatccaaatacaaagggtgatgtctaaccaccacagattttagaagtgcaggacaggaaaataagttcacaatgagctgttttaaaagaagtttgtttagctcatttgtattgaaatataaattattataatgggcaaaatattactaaccacagatgaggacttgaatgagaacccatggctgggattcatttcaaagaaaaagagaactgagatctgaattctagtttccagttcagcatgttccacagcttagaagtcaccactccatcctaacaagtaaaagccgaacaaactgaaaaagcatcaactttactcagattcatcagagaagtgaggttacaaggcaaatggctaccccaaaaatggagagatggacaagtggtgatatggtttggctgtgtccccacccaaatctcatcctgaattgtagctcccataatccccacgtgtcgtgggagggacccagtgggaggtaactgaatcacaagggtgggtttttcccatgctgttctcttgacggtgaataagtctcacgagatctgatggttttataaaggggagttcccctacacatgctctcttgcctgctgccatgtaagacgtgactttgctcctcctttgccttctgccacgattgtgaggcctccccagccacgtggaactgtgagtccattaaacatctttactttataaattacccagtcttgagtatatctttattagcacatgaaaacactctaatacaggtggacacagagaatcaaaacttactggagcagaaacccaccagcagaaagttctgcaagaaccagtaccagggtaggaaaacctaaacagtaattgacaaattgccagaagctccatgtggacaagtctgagagctaaaaactccaggagtggcttttctaactcagtaagttaaacaaacactacaggaggacacagtcacaaggggaggagggggcatgcttttgtgagttttaccaccagaagtccacgttctcatgcttttgggaggcagagaggaaaagaaatcactgtgaaatatggcagggcattctgttcttgctaacaaggtttgcccttgggacaaaagattttaccagagcctaacctgcttggattacatcagagcccaacctacctggggtaaagaaaataacccaacttcagctccctgcagccatcctgtcccacactagggtgatggccagggcagggagaggacactgagaagcactgtgaagttcaacaggggcacaagctcaccaaaagactgagacctaatcataggactatagaacacttcctgtccccccacgcctcaccaccacctcactaaaggcctgtttaccacagctcctcttacccagtacatcatgaccacctttgcccaaacacttacaaggcaaactaaaaagcaaaacacagttttgaagagactgaaaaacatcagaaccagggttccataattatgtcaggaaggttggaattatcaaccagggaaattttttaaactatgattaatacactaagggcattaatggaaaaagtagacaacatgcaagaacatacagatcatgtaagcagaaagatgaaaaaatcttgaaataagtcaaaggggaagacaccttatctataaagggacaaagacaagaattacaacaactattccttagaaaccatgcaatcaagaagagcatagagtgaaacatttaaagttttaataggggggaaaaaaaaaacccggccaacctaaaatcctgtaccctgtggaactgtccttcagaaaatgaaaataaagagacaacactggaaaaggaataagtgaagataaaattttaaagtttattttctttattcttaattgatctaatagttaacagttgatatgctaggaaaggagagaaaatggaatcatataaaatgctcaattaaaaccataaaaggcagaaaaagtgtggaagacaaaaacagaaacaaagaacaagataacaagtagaaaacagtaacaaatacgataaatattaatccaactatattagtaatcactttacacatcaatggtctaaataaaccaatgaaaagacatacattttcagagtggatcaaaaaataagacccaactgtctatataaaaaaagcccagtttaaatgtaaaaacaaatt

SEQ ID NO: 1598 - DNA, 2399 bp, Homo sapiens
taattaattaattaattaaagaacaggccaggcacagtggctcatgcctgtgattccagcactttgggaagctgaggtgggcatattgcttgagcccaggagtttgagaagagcctgggcaacatggtgaaaccctgtctctataaaaaattagctgggtattatggcatatgcctataatctcagctgcttgggaggctgcagtgggaggatcatctgagcgtgggaggttgaggctgcagtgagccaagatcgtaccaccaaactccagcctgggtgacagagtgagactctgtctcaagacaaacaaacagactcataaattagctgtctttgaactcaaatattagtctaaagtatgctaatatgtgaaagtaatatgttgatttttgagtgtgaaataagaatactctaaaaattaaagtaagcttatgaaattcaaataatttttacttattagtggcttataattactgtgaaaggtgtatgatctaaacagacaaatagcatacttgtttaacaattagacagtggttaattcataaacttctaatcagacatctgtctttggatagtagctctggcattctttccaaaagtttatttactagttaaaaatgaaatgttagaaagctgttgttttggaaatgtataattccaaaagtaaaccttgcttttgaaaaatgaaattgttatatgtgaaggagggttataataacagagcatcattgttaataaaaacacatttgagaacaaacagttttaaagtttcaaatccatgcacatgaccctcacagccatcatgagaggggaggggcatggggatggcctcaaatgacttgttcaaggtcatgtgacatggctaagtgagagagctggatcccaatagaaaacagtctttcaggctgcactgctttacatttttttctgactgaacttcgttaaatatgatttctttccaatttataatatggtctgtttaaacaaataaaactccagaatttctcagaccagtgggtggatgatatgttttggctgtgtccccacccaaatctcatcttgaattttatgatagctcccataatcttcccatgttgtgggagagacccagtgggagggttttcctgtgctgttctcatgatagtgaacaagtcttaggagatctgatggttttataaagggcagttcccctgcacatgttgtcttgcctgccaccatgtgagatgtgcctttgttccttccacttctgccatgattgtgaggcctccctagccatgtggaactatgagtccattaaacctcttttttaaaaagaaattacctggtcttgagtatttctttatagcagtatgaaaatggactaatgcagtggcactgggtcctccaggagtgagctgctctggaaagtattcaagtccttgccatttgttcttcgaaggccagctcagttcagtgtagttgcaggggtttacaggtctatctgtggactctgtccccaaagcttggatggtgttaaggagagtctctcagtacctgtgtgtaaagccattgttcagtgcttacccattctgctgtgtttctccaggccagagctctgggagtcacactggctcatctccagaacctgtatttttctctgtcagaaacattctctatatttgatgggctgagaaaaataatctattcaacctgagaaagctcattaaaaaaaaaaaatctgttgaataaaaggttaagttggtaagggaggctttggttttatacatacgggaataaaagtctcttacattgctaaaaaaccctttgtctttaaaagcatcaatcaatattaacagtgcttttaaagtgagattacattattttagaaagtaatcatgattcagaaaattaataaatgcttatgaatcatgcttatgtatttcattttaatctgtagtttggaataaagttatttcaaagagtgtttttggttattagaatgtttagctatgttatgatataacacttaaacttaatttcagtaacaacaaaacaagaacccataattttaggatctgtaatacagcctaggaaatgaggtctggtgggaatgcttccaatttagtatctttgtttttcagagaaggttatgaactctcttcaattaatccagatacagatagcttcgattactactgaatttatgtgaatgattatagtagactaatgagttaatctgttagcaacccattctgacctgtgatgtactaggccagttgctttatctgtatgagttagttttctcgcttcttttagtgagagtgataatttctgtttgttgcaagggtaagtctgttttaattatggcaatttttttctgaaatacttacttttaaaactttgtattatagaaaactcca

SEQ ID NO: 1599 - DNA, 1868 bp, Homo sapiens
gaaggagggagggaaggaaggagaggaggagagggggagattgatttttaaaacgaattaggggccaggcgcagtggctcatgcctgtaatcccagcactttgggaggccgaggcaggcggatcacgaggtcaggagatcgagactatcctggctaacacggtgaaaccccttatctactaaaaacactaaaaaattagccgggcatggtggcggggaacctgtagtcccagctactcaggaggctgaggcagaagaatggcgtgaacccgggaggcggaggttgcagtagccgagaccgcgccactgcactccagcctgggcaacagagagagactctgtctcaaaaaaaaaaaaaaaaaaaagccaattagggaaggggagctcagtttgggacacactgagtttgtatacctgtgggacaactgggggtataacaacagggagttatcagtgtgggactgagatttaagagcaagatcaaggacagagctagtgatgcaggaatcatacttagggaggcagtattgccatgagagaagaaaggagaaagaattggacatgttagaaaatcccaataactacagggcagtcggataaagcacagcctgaagtaatatcaaagaaggtataagaagagggtcagaaggaagccaggtgaaaagatagccatggaaagggtacagtcagtggcaccaaatgctccaaaagcatggaggaggagacagaggaagaaaacctgatgaaaggtcactggagttgcagggtagcagtagagctcaaaacctactacctggttctcatcttttcttctgagcagcttaggttgctggataagtgaggtcatgaataatgaggtcatgcatgcagataaatgcatgcagtctagaacccaaaggaagtgagattccaaagatgtgagctctgctctcctctgaccctcagccccaagcttggaaggacagcacagacagcatccaatacatgtttgatcccagccatggccctaggtccaaaggctgagctcccttcccaaaattcagataggatgtctctaacactagcacacccagcatatgcttgggtccctcggttaacgcgcgcatccagctgggacacttcgtagccatgccttgatgttactactactcaaggtcttccaacaccagcagctactaactggtcagtgctataaccatctccatctgcaataacaaatcttctacaatgttacattaacatcaaaatgatgacattcagagtataacagcaaattaattccttagaaacagaatgaatccaacttgccattattaccttaagtgggaatccaaaaaggctgtaataaataatataaacccattatatttattcatccctgatctatcctttataatattaaaccaaagaggtaagcaccatggaggagaaatcattatttctggtatgacaaggaagagactttgctggggaggggggcgttgcttgacaagaagcggtgaggtatcttttagcaaaggcaagtttataatgaggactgagtcggcttttttatataagagcaattcagctgtgaaatgggcttccccagaaatgaggtgggagtccctcagcttcttgggagccgtactaatgggttagtcatgtatgacagcttgcatagtggttactccagttgagaaggctttggacagccttcctgtgatttatacaatatcaattggaaaagcatcctattttgccaggaaagatgtcctggaaaaccaagcccacgggctcctataaggcaggtgcttcaagctaacttcaggtgataaatccaccagccccctaatatgcccttttagaaaacgcttttgcccaaaagtc

SEQ ID NO: 1600 - DNA, 3579 bp, Homo sapiens
taccaacatcaaatatttaatttgcagctaagactctttttgcttaaagccatgaagcagcagcacagcatattggctgaatgcacagaccttagagccagacagcctaggttccggtcccagctgaaagaccttggccatgtgactcaacccttctgcctcagtttcctcatctgtaaaatggatataactgaacttcccaggatcattttgtacattaggaatattcatattaacagagtacgtagaatattacccaatcccctaagagtgccaggtaactaagtattcgttaaataagaagcgctccctcataagccagccctctcttcaaaaggtgacaactcttttttttcttttttttttttttgtttgaggtcttccttaggatcttcaaagatttcaccgaagaaccagcatgtgtccctgacctgatggaatgtgtccttaccaggataaaaaatcgatgcaatactgttggaaagtgaccccatggtttgaagcaaaccaaattatacgttaaagcaaaaaattacctccagaataaacgctaagcacagtgactgtctacaaaggccatgttttaagcattcgcactccaggaccctgggcttagtggcacattagacactcaataattgcatatctagcattcagaaacttttaagtggttcttattttgattcctttcccctctctgtagtgggaactgccctcaatcattctgacaggtatttctcttgccgcccacaaattttcagccctgcagtataccacattggtctggactctagcatatgcaggatttatgccaggcttgcaaaagatccctgaatcagccagtccaaaccccctctttgtgccatgtctacctcgggtgatggcagtgtgacagcattctcacctccacccccaagacacacacacacacaccctggatatctcaccataataataatgtattttatatcatgagcaggggaatacgattaaatcttcctcctataccccaggttcagaaaagaataataatgatttcctatattatgtggaatctcatagttcacaaaataatttcagatccaccatctgctttgaatgtcacagcaccctgtgtaataagtaagtcaggaatggtgtcccattagccacagatcaaagaagcatggaccagagtaaggaagcaattttctgaaggacacacagcaaattaggaggaggaatggaccccacacacaagtctgtgtactctgggctaatgctcttcaaggcctttttcctccttgctctgagcttacttcttgcaggtgtcagaaaggtacattgataggacaacttgcttcccccagacagccccacctcttcaaagatatccacaagtttgcccacacaagtattccatccctacctcctaatttccacctttacaaatggcacgtcccagccccacattgcccacagcacctccgggtctctgcttctgtctaaaatcctcatctccattcttgtgcctccaatcctgccagtctttcaggcccatctttaacagctctttatccaggacactctctgatgctgccatcacagcctgcaacagccacaggagaagccacccctctctgtatccctgtaacccttgattcttcctcgcatggtcatcatttctggtcttgggacttctcttctattagcccagtgggtacctggagggcaggaaccagggtacacttgccttgggagctcccacagacctcacatggtacctacatctagtagggactcaatcaatatccatgcattcattgtattaatcttggaaggaagcacaatgtgtattacatagagggaggtttacctgtgcaaggacaacccctttataaattcaagaatatagacacaatgtgtcgggcacagtggctcatgccagtaatcccagcactttgggaagctgaggcaggtggatgacttgagatcaggagctcaagacaagcctggccaaccagggtaaaaccccatctctactaaaaatacaaaaactagctgggcatcatgacacacgcctgtaatccccgctactctggaggctcaggcaggagaattacttgaacccaagaggcaggggttgcagtgagctaagatcgcgccactacactccagcctgggcaacagggtgactctgtctcaatttaaaaaaaagaaagaaagaaaggatatacacacaatgtaaaatcactgcaccgagtcagtataggggctgccttaaactcagggaacagccaaatctgtttatgaattaaaagaacagtcactaaggaggcaagatcaagtatcatcaaaacattaggccttgacatagaacctgaaggattcccccaagccctagggctgtatccagacagaattttcattccataactatcacaaaatgtctctttcatttccagctctgtgttagaggtcagggacataaacggctctcatctccaggccctgccatgatggacctcacagcctaatggggaaaagagacacaaaaccagacaatgacagaacaatataaaagcactgggggacacccagacaggcataatagcgcaaagagggaaggtgcccaggtgggagaacctaggctacgttatgaagatgacatttcccatgcaaatacacataaacgtgtctatcactcttgtgcacatgtgtggggctgtgtgttgggatggcattaatagtagctaaggtgttaaaaaatacaatactaaaattcccaggcaaagcaaaagtttccaccaattatccgaataatttttccaaaagttcagataataggcacgtttaagaaatttctggtacaaagaaacaaacatgtggctaccttttcctttttagcaggatgctttaatgccacataaacacatgctcattaccaagctgaaagctgatttacatagcatcacctctgaagcatacaaagataagaaaattcaagtgctccgaacctcagttttcttaacaataatacggaagtaaaatacagacctcgcaggatttgctggggggagattccatgagatgatgtatgtaaaagactctttgcaatgaaaaccacaatagcaagctcttgatcacttttagctcacacgctgggaatcagcatagtattatgggcaggaacatggactggagtctgtggatgtgggttcaaatcccagctccacccaactgcaatgatctgaggcaacactacctatgtagcctttcttagcctgagtctcctaaactgtacaatgaggattttaatgcgtacctcatagctctaatgattaaatgatgtaatatggtgaaataccacagtacaggtagtaaattctcaatacagcataactagcatcatgttactcttgtcaaatattttgtctaatatttcaagggaaggtcagaagatggagttcacaatctacataatccacagatgctcaggtgttacaagtagtgggagggagacggcacaatatgggacaggctaagagttctgggtctgattattccattcagctgctggcatggggctgactctgggag

SEQ ID NO: 1601 - DNA, 2103 bp, Homo sapiens
acatgcaaaatgtgtgtttaacaagggtctggcatatagtaaatacttcataaacattagccaataaagatatcaattacccaacacaatgactgacacattgtgagcaataaataaatagtaatgtaatggttaccattacagatggcccctgatttatgaccacttgacttatgactttatgatgtttcaaaagcaatttacattcagaagaaaccatacccatacaacgattccgtttttcactttcagtacagtatttgataaattgcatgagatattcaagatgttgttataaaataggctttgtgttagatgactttgcccaactgtaggttaatgtaagtgttctgagcacatttaagataggctaggctaagctatgatgttcagttgcttaggtgtgttaaatgcattttagacttacagtattttcaacttacagtgggtttatcacgatgtaaccccatcctaagtcaaacagcataggtatttccccagttctgaatactgatatccagtagattgcttttctttctaccaggtcaccagtctcatctcccttgttggagctaatggaaaatggcagtgagaatcaataatatagaaatcacatattggcagcatcatggaaagctgcctgggaggaattcagtggggatctgggactagaggtggctgctattgggaaggattccacatccagttgttgttgatgtgcgaaataacaacttgagaagtgagaaaatgccacagtagaactccaggggctggaccagctctacagacccaataaagttgagtcaacgttgaaggtccttcaagaaacgtccattctttccttcctctatccaacatcaacttccatgcctgtccaacatgttcctgccaaaaatgactccctgtctccctgccatctctggggggcattatttggcttgggctcattttccctccatcccctaatgaagtttcaattgctctttattattgtcatgtactatttcccaaattctcaggcaagctcagggaaggaggtatcagaattctgccagcctcactggctttgatagatatttgccagtgcctggttgggctgctttgattttgtgtttctgagttcctggtgaggagctggcttgcaggaaacacatcattaagaggagctgtcagaacaaactgctttgtggccccagattgcttgtaggtggcaggtgctgaagccttgggtccaggctctacctgagtgggtaaatgtttaccgagtgccatcggggggtcctgactcaagtcacctctcttctcccacagtcccactgtggggcaggtgttctgtttcaaagaaaaaagggacttgttccgtaaaatggggacattgaaactttggcattttccttcctcattacgactttatatttgttatgaaaaggtctggctgtgaataacagagacccagataacagtagctgaaataaggtagaagtttatctcactctcttgtaacagtccagagggaggcagtgtagggctggcagggcagttctgctccacaaagtctccaggtggcctgttgcttccctgtgcatatcttccatttcccaaggtcacctcattgtccaagagggctgttacagctcctgccatcatggctgcattccagccatcaggaaggagaaaggacaaagacagatcactcacttgaaggactcttcccagaagttgcaggcatctcttccactcacatccctattggccagcattgagtcacatgaccactcctagctacaaagaaagctgagaaatgcagtctttattcctagtggccatgtgctcagccacaacgcatagctgctaggaatgtgagctctgtcactaagaaagaaagaaaaatggtcgctggtggagaactagcaggttgtttggaaagagtgatgatgctgtggaaaacattgccgaatggaatcagaggacctataagtttgcacttcagtctgtcctataactttctcaagtttcaatttccttacctatgaggtggggatgatggtgactacctcacaatttgtgaagattaaatgacatggcatattggaagataccttc

SEQ ID NO: 1602 - DNA, 2077 bp, Homo sapiens
cttgagcttcatggtagaaagcattaatttaatatactggtgagatgtaacaagcttaatttcttttagtaaaatggttgtcgggggggtggtgggtgcagggattttgaggtttctgagcagcattttctattcctagaaataccctcaacaaatagttgtgctatgtacaattgccttacatggtgtgttaactaaagccgccaagaaagggagaagctggagggatacaggtaagagaagatcctttgaggaacgtatagatttggtgaactgttcagaatgcatttccacagacattaaattgagagcacaacccctccccaaatgactgtagcatgaacattcaacccatactgttccacgtctgaaagagagtaaaactggatgaacaaagaggaaaatgagtccaaagcacatcaaaaatattccttacccaaagcagattgttctcacagggcttttttcacgtgcagatgcttttactgtggaaacaaaacaaaataattaatgactctacatttcaggaagcgagagaggcattttggaaatccgaatactgtcataagctgcataacgactttttggttaaccagggattgcatatacaatatttctgcatttaggtatgtttagatacacaactactaacccttgtgttacatttgcctgcagtactcagtacagtcatgcactactacacaagtttgtagcctaggagcaggaggctagcccatatagcctaggtgtgcagcaggctatgccatctaggtttatgtcagtgcactctgtgatattcacacaacaataaaatcgcctaacgatgcatctcagaacctaccctcatcattaaacaacacatgactgtaattatcaccagcactaagagagaggtatgtgaagggccagccctctgagttcctgcttcctggttccctccgagttcccccatacctctctggagcccctgatcgcttcctcgggccatgtacatttccaaccatcaccagctctagataaacaaacagacagaggattcgtatgtggccttcgttaaggtgggtgccaattgtcaaattagtttctgcccaacctgccgagtgcaaatgcaaatccaccacccccggcgctgcctcatttgcagttattgattcatgtttgactgtgagttcaaaaaatgttgtctttgaagcttccccatctatgcttggcttcctgggtccaggtggctcggggatccctggcagtcattttgatctctgtattccaaacaccaacgcaggtcatttcaggtaacttaaaagcaagatacaatcagaaaggatttggaaatgaagtctttgccttgtcacattaatgcggtcctatcaagtggtagtttatcaagagccacctcacaaggttttaatgagcatgctgcttgttcttgtacaatactaattaatcccattttttcacactgccgtgattgcttcatgaaacccacattgttttatactcagtagcaaagcgcctcttactgattaaatctccttgcctgcgatggagcctgacaactgaattataccttgctcaaaataataatgggtatcagctaataaatacggtttaacacacacaaaactatgcagccaaaatcacaccacaaaataggagtttgacttataggctcagcagtgtttcattaaacatctgtattataattcactggttttccaactgatgtaataacttaattgatgagaacaaagacaagcttatttattcacccaattgcttgcttcttgactaacgtttttcctgggtgttattgtggaaataaatatgcaatattctttttatagaagtctaatttaggtcctttttttcccctattgagaagtcagcatcaccatctgtatctgacaaattcttgctgctttgcaacggaagcatttcgataagatgggaggtggtgtttaccctgatattcagactggctagccgatgtgagaggggaagcattggtctcctagccccctgggtagtgcatgatgagtgttccctgatttccctcacaaggctgaaaatgccatct

SEQ ID NO: 1603 - DNA, 1569 bp, Homo sapiens
gtttaaacatttgtattaaaatttaagaaaatgctgtgtttcaaaaatatctaaatttacttgtgatatttagatgattatttaaaattataaaattctgtctttttcttgctggagttacaaatattgtttgggctgatgtttttcattagcggtagtaatttgtgtgttttattgtttttgaaggaaacatatgggacagtgctttgggattatgttgaccctacttttggtctaaatattgaattaaatttcaatgtggaaaagtaaaaatatcataaagacagtatcattcttatatgtgagggtctgtgtctacaaatttaataaaaatcaatataagaacaattatctaaatagtgtggctgaacacatggacccccaaattcttaaaacctaaatgttctttgtcattcgtattccatgataatgtatgcatcaaagacagacttggttgatttttgttcccttcaattattcactgagacctcaactttcagtcagatcagttgcttcccactcaactcttgcagattgcaaatcttccctgttgagttgcacagcaactgccactcaacctcacctgcaaaaggttagtccaacatctttttttaaaatatatttttgtggctctagaaataagcaagccagctggcagtattctaaaccaagatgctcagatcttgttgttaagtgtaacaccattgccttcctaatttttgcaactacaagagtacaataaaaagtacgttctataaggaagaagggagcttgaaatctaagcttatctctgccagttactggccatatgattttataattatctcccttccccttttttagcttgcgtttttttatttctaaggtgaagtagttaaatgagatgatcgtttggattgcttccaggtctgacattctgatgatcacatgaaataaaacctttgtgagtgcactgtgctaggtggtcttatataccactccaaggctgtttcattatgcaatttatggtgtcaatattccttatactgtattctatagtaacggtgccttctggaggacattgcagagggaggcacttacatatattaacatgtgccactcagccacattctatgccctaataaaatacttgaggaaaaagcaaaggaaaatttgaaggggtggggtctatacattttatgtagggaatctcaaattcagaatggttaagtccattgcgcaaggtcatccagtaagtaagtggcagccgtggtatttgaacatttggtagccagattcctcaagcagtgcccctttaatcaggctttaacgttatttttcactggattatgacactcatatattgtatttttcaggctcatttgcaaatagaaaaaaaagacagtcaacgcaatctagcttaagcgctccataatagttaattaattaaaaataattattagtttaaataaatgaaaggtccatataaaaattgcatcaagcttcaaatcaagacttttctctctacctctgaatcctgttcctcactatgttagttttgttctaaggcaagcatgtcccatgtggtaa

SEQ ID NO: 1604 - DNA, 2005 bp, Homo sapiens
atactttgccactaaaaacaattagttaaaaaaaaaaaacaccactcaacgggtagctgactgagccaggtgtcatggtcatgcctgtgtgggggtttcctttcccattcaggaacctcactgccagctccccgcctgggcacggggccctggagagggcttgggggcttggagagcaggcgttctgagttaaaatagatgttgctactggctgaacagtttgaagatatggagcttatgacctcaaaaggaagtgtataggatgcgagggagggtaacaaattatggaaccacttaggttgaagaaccatttgaataatgttccaaggaggggcacataagtggtcataattacttcggggtctgctgtctgaaccgatttccagtctttcctacttcctttttcaggcagcaagttccagaaactggctactcactgcatgaacttggcaggcccttttgcttttcttatgtttcacctctaagggcttaaaagggagtcttcacgctctgtgatcagaggccctgcgtagagagcactatctcctccacgctcaccccagtgctattagaaatgcaggttgctgcctcatcgtgggtgcccacggccacctcatttccttgtgcgtttcacttgcctcttttgctcttttgtgcagtgccgttatctttttcatgaagtgtggcttccacaattgtctgtgacgtacattttatttacctcgtgcattcattccactcgtttcttgtcggatcactcagctggttgtgattgtgcgttcaggactctgaagtgccaggtactggcctaggagcagggggtgtggttggggacagtgtccagaggcttctttgaagctgacgcagggcctcacattggcatctctggaaatagtgaacacccagctccagagtggattagatgttagccacccctttataggggaggcctgagcaaatgtccctgagtgaatatcacttgcatctcccagagtaaaggcatctgacggcctcacttcagaggcttcctgcagtctgtccatgtttgattgtcattctcctcctctagcctgagtaccctggagatgtcacttttccttctcagaaaacactaagtaaggtgttccctgaggaggacccgagcccaccattggttctcttacccagggaagtgtctggccctctcctttgttctctgtctttaatctacttcctgtcttatgacaaagaaatctctgggagtttttaaactcaagaattattttaaaagtcacaagataacaaatgtcaagcccccaaaccacactgcctggaggactgcacatctgggagtgcctgggccgggccccagtgtccatgttggtgaaatagggagcggcgctcctctgaaggattgttcttgggactggcatgggccaggtcagtagcagtgctcagtacagtgctcacagaaggcagggagggacggattgctcccctcctttttcttcccctcagagtatgtatgttagttgagaaaaaaggaaaatcagtgaaacttaacaacagtatcagggtgatgtgattctcaagtgtttttatctctatattttttgtatcatttatttttatttttttgagacagagtctcactctgttgcccaggctagagtgcagtggcgcgatctcggctcactgcaacctctgcctccccagttcaagcgattctcctgcctcagcctcctgagtagctgggactacaggtgcgtgccaccatgcgtggctattttatttatttatttatttttgtattttttagtagagacggagttttgacatgttgctcaggctggtctcgaactcctgagctcaagtgatccgcctgccttggcctcccaagtgctaggattacaggcgtgagccactgcgtcatcctatgccattttaaaagtatttattttgaccatttactaatttcataattagaaaaggtaagcattattttaaaattattacgggtttagaa

SEQ ID NO: 1605 - DNA, 1756 bp, Homo sapiens
catgtgtgtcaggccccatgggtagcagggaaagatatgtggaactctatgtactacctgccaagttattctgtaaattaaaactatattaaaaatataaagtcttaaaaaatgtataaaaagcattcttagctcacaggtaataagaaatcaagtggtgggttgggtttggcctgtgtgctttcattgtatatgaaccttcagacaagctgggacaaaagctcacaaacgtgtgtggccctcacatggggcagaaacgatgttgtgggtcggtcccatgggcagtggcaacaagtgagcagagtcaacatgggccagaggagggttcttgatgggaaacttggatgggagccttaaggaatgggcaattccccctacttctttatgctgtttgctcaggatctaatttagaaacatgagcaggacctagaagcaacctgagaacccacagggcgtgcatgaataattttgacttccttgagcttggaaaagccattcttcatacttgctgttggtctaaatagctgtattatttgcggcagaaactttgcaaaccaggcctggagggagacaggaatttctccagatattgtgctgcccttaataagctgttcaccctcctggcttctggaagatggagtaatcaataaggcatcattttgaacagtataatcagcataatttatttggcaaacacatatgagtgcccactgtgtgctcatggctctctcggctgtaagagcttatggcaatgatgaggtgatgttggaaattgctggtcgaaacctccaagtaagagaagaaagaagtggtgtcatattgatctcatggaatagattttaatgctaatagattttaatgcaacccaatatgctccctgtgtggcagcttagggcctggttaacagtcgtctgtgactgtttcagctgagcctcactgtgcatccaattatgagaacacattaatcagtcacttgacaaaatacgtatttattgcttctgatattttcattatgttggccaaggctcaacctagttttataaagaaaaggaatgagccggttgcccacagggatgttgagaatggagacccctctggtttcccacctggagatggtcagcagaaaccaaggcatatcctaaaatgttggtctctgcattctcactattctctctccttggacttcagaaggaatcaagacctaattactatctctactcctgtgttgagtggttactgtgattacctggtcaataactcattgtctatagatttcaatactgcttggggattttccattactctccatctacagcagtgagaactgtgctgtgttctacaggacctcttttctaggatttgccttctatctggaggcttaaaagaaggactgagcaggcttagcaaatggttcagggtgtgggagcgtgagtcagacttcagggatccagaatgcctctccagctctgcgatcttggttatgaagttatctaacttcttgcgccttcctgcaagtcagcccacctgcaacatggaactaacatgcatacctatttgtaaagtgcttaggatgattcctggctcaaagtgtgcaacaaatgaatgacgtcagtaaagagaccagagcagtgagaattagtcatgtccagagcacttttgggaaagaggagaaaacgtgagaggcggcctgctgtggggaccgagttcagcatggatttcacagctgaaaacgcatacctggtttccaaaccacatt

SEQ ID NO: 1606 - DNA, 4403 bp, Homo sapiens
cgtgtgtgatgtacgtgcgtttgcacgcgcgtgctgtggcgtgtgtgatgtacgtgcgtttgcacgcgcgtgctgtggcgtgtgtgatgtacgtgcgtttgcacgcgcgtgctgtggcgtgtgtgcgtttgcacgcgcgtgctgtggcgtgtgtgatgtgtgtgcgtttgcacgcgtgtgctgtggcgtgtgtgatgtgtgtgcgtttgcacgcgtgtgctgtggtgtgtgtgatgtgtgtgcgtttgcacgcgtgtgctgtggtgtgtgatgtaggtgcatttgcacgcgtgtgctgtggtgtgtgatgtaggtgcatttacacgcgtgtgctgtggtgtgtgatgtaggtgcatttgcacgtgtgtgctgtggtgtgtgtgatgtgtgtgcatttgcacgtgtgtgctgtggtgtgtgtgtggtgagtggatgggaggatatttccagtgctctcctcctgggactgatgccatgatgaaaatctgtgtaaaccagacagcacatctctcatcatttctttgtgatgggtcattagaagcaggattctgaatttctggttcagaagctctgttacgtggccctggatccacacatctaaacgatgtttcagaaaggtggtgccaatttatattcccagcaaggacactggctgtaccatgtccccactgccaccctggccctagttctgtcatgtgggcattcctttggacgtgcttcccaagtggacaggtgtgaggtggccccaatcaatcccacatttactcaattagtggagaggctgagcacttaaaaatctgcttagctttggccgggcgcggtggctcacacctgtaatcccagcactttggaggacaaggcgggtggatcacaaggtcaggagatcgagaccatcctggctaacacggtgaaaacccatctctactaaaaatacaaaaaaaaaaaaaaaactggcctggcatagtggtgggtgcctgtagtcccagctacttgggaggctgaggcaggagaatgcttgaacccgggaggcatagcttgcagtgagctgagattgcaccactgcactccagcctgggcaatagagcaagactccgtctcaaaaaaaaaatctgcttagctttcctcctttctttttttgtgcatcacgtttgtgtttgcgttttctactgagggtggtgggaatggccttgtgcaaacacagagattcactggggcatcggacatctctcttccacctacaaacacagcttctgggtctgtccagccacatcacagaggtcacatcagtctccggggctgtttgtgacttgtttcgtatagtcctggtgccttcttagagtttgtccctaagtgtttaacatatgcccaacacatacttataacatatgcctagcatgtgcttaacatgtgcgccggacagaggtgctggtgatgtgggtggttcagggaatctgttttatccaaggatcattagttatattgataaataggcaaaacccatccaaactggctgaagcccccaatgcaatgtttttgaaagggaatggggctttctagggcctggaaccaaacaataaaactttttgtcaaaggccagatagtcattattttaggcttggcgggccagatgtcgggacccactcacctctgtgacgtaggtgaaaagcagccttaggagatatgtacatgaatgggtggggctgtgtgccaataaaactttatttacaacaggctgcagccagattgggccttgagctgtggtttgtccctccctgctctgtaaggacacagccccttgctgctgcttctctactttatgcccccatttttgctctctgctcagcccagcctttcctgttttttttttttgtttgtttgtttgtttgtttgttttcagcacttagaggaaaacggcccctggccgacagccaaggctctaacagcctctttggccctcctagtggcattataaagtttggcgttattggcaccatttgacaggtgggaaaacagaccagaaagcccgtgtgacatcgtcaaggttacgaagccacgaagcagcagagctgggcatcgaacccacagctgcctgctcttgacactggccataggagtgtagcatagagcaggggcaggcatcgaacccacagctgcctgctcttgacactggccataggagtgtagcatagagcaggggcaggacgggtccgaggccgtggcgcatgcctgtgagccacagcacccaggtatggagaagaaggaaagaggggaagcaaaactcagaaaacagctgaaaggcctggcctgtgcggcccctccgagcctgccacggagcattttttgccgggcagataatgatggcaccataatgatgactataataatgaaagataaaggaaatgaaacattattaaccattgatggatagtgtattcagttttcaatttaatgatctgcaactgcaaatctatagtcaagaatgaaccaatttctcacttcctttttgctctgttcatcccagataaggaaatgaaaggattactctgcagacatggaacccaaatgtcaatgttctgcctcattagaagacctggcgcagacgcccctgaaagcccacgtggttctggtgatgttgcccggctcacctggccagggggctggggatggccgtgggcacccacaccaacctctggcctcagcaggcaggaaaggcggctcagaggcatcccagatccggacacctgatccctctctgtgagtgccctggtgctggcttcttttccttcccccttcctatgaatgtgccccagattccatgtgttaagtattgcgctctggatgtgccagcccatcctaatgaggagcaagggatcagagggagatggtgctcagattgatggtgagttggccaaggtgagcattcatatctccttctcaatgcccttttgcactgaacactgagaggggatgcaacccagactcccagatctggccccgctttcttcccggcttgattagctggacaggaggcagtgcagggtgagagccttctgttcaaagccagacctaagtccagaggagtgcgtgtgctgggactggggttaatgctgacgagctgcctccctgtgtcatatggacttgaggacccacttgctttgcgaagctcacttgtccagctgtttcacacatgtgaccccatggaacctgccagacccagccaccgcagcttctgcggagggcatggatcaggcatgttctttccatgctacttagtgtggagggggcgtgtacgggtttcagttcagaagtcaagagtaacagctaatgcttttacttcaggagtgaaattacaagcaaacctcctgctcggcagctttgtgcaagtaaacatatgacagcgtaaaagctttttaacatccctgagtattgctctggttcacaagacgttgaaaactgaaaataaaacaatgagaagagttgtgtttgtcagcccagcttgcagggaagaatcccgaatagctgacgagttcatttttacttatttatgggcaaatttcaaagttgcatctgttcctattctgtgagcactcagacatcctctgggactttgtttgtttgtttgtttgttggtctctgtgtgactggcatttgcctgaagtttaatatcaagtaggccagatggaagaatgggcaagttaactccagagaagccgattgtcttaaacatactggatgtcacccttctcaatggtgcttcctggagcatttaatttgtgggacaggtgtctcagtgggacacgaatcccccagctgtgcagaacagtcaatggccacggactccaggtcccctccgtgccctgctccttggccctgaagctgcaggtcctctgtgagcctcagtgtcttcgtctgaaaaccaggatgagactcacagcagccttgtcatgtggtgaagtgaggggagcttgtgtgttggtgactttgtggggtgcctggcgggcagtctactctcagtgcacactacatcttctttaaaataagcacgaataggggcactcatggccagcttgggcaacatcgagagacctggtctctacactaatataaaacatagctgggtgtggtggtgcacacctgtaatcccagcttctcaggaggctgaggtggcaggatcacttcagcccaggaggtcaaggctgcagtgagctgtgattatgccactgcaccccagtctgggtgacagaacgagaccctgtctcaagaagaagaaaaaagagtgcttatggggtcctgtgagtggctgagccctattcattttctacagtggggtagcattcacaagggatgccccattgacttctgttccctccctgggcacaggggtggggtgggagcctggagtt

SEQ ID NO: 1607 - DNA, 1989 bp, Homo sapiens
attctggaggccttgcagcgcactttcctgccctctcgcgtgtatgatagagacattagcgcgtgtcagcccctttaccggggcttcccattgtcttagcgtgctcctttcatctaatgagcaggcgcccttggctgaacttttcaggaatccgtggggaaccagagtgaatatattatggcgctgtggagcgaatgacaatcgggcagtgctcgcctgtggccgtggaggtatctgcgccaccgcaaaatgcctcacccttcttttgggttttggggtttcaggtcagctctgggggcccgttatcccgtgtcaaggaggcccacgcaggcacccgaggaaggctttggctatcacgaggtggcctttgtgcaggcgggttcagcaactttggcattcattggggcagcctgttactggtgcttggagtaagtgaagagtgcgattgggcgccagagctgacctggcagggagccgggtttccggcctgtgtcagcggctgcctaaccgtggacaccagcacgatgactcagtcctgaccgctataagcatcccggccaccagctctgcatcatcagggagatcaattaaattgagtgtgtgtaattctcggggattagacggaagtgcacaggcttcattgatccactctcctagacaatcagcaggcccctccaagggctgaggacccaccactcagcaggaagcctggctcacttctcccccacaccccttcctcccgcacttccccacgttcctctctcctggattggatttctggaaggttctgctgggccacgtcccgtcaggtcctcaggaacacggcatgcacaaccacacaccccgtctgcaggggctgcaggtaccctgaggccctgggactctgtgtttttctgtggttaccacttttcctttgaacaataacattttttttctgagacacactctgagacttctggcacccaccgtaccttctaattctactataatcatcacccttttctcttgccaaaaaaaaaaaagaaaaagaaaaataaacttaaaagaacacagactgaagaaagtcatttccaagttaagctgcgaaggggtctgaaatgtatcgctggtgagagtctttttttttttcatggtaaccacaaaagcaagtgcactagtgtgtctgtgtatgcggtaaacaaaatggtttgccaaactcaggaactaaaaatgctctaaaagaacagagttcatttctgaaaacagccaatttggaaccctggcaccagtattttgagtcagaagatcactgagcattatgggttgaattgaatctcccaaaatgccttttgctgaatcccaactccagaacctgtgcgcgtgatcatatctggaaaaaaaatggggggtctttgtagatggaatcaagttaagagacagtcagagtggatcagggtgggccctaaatccaaagacccgtgctcttataagaaaagaagaggaaaccgaatccagtgttagacagaggccccggggagaacctcgcttattcgttcatcacggagcagagatgggagtgatacatccgcagacaggagccccggggactgccacagccccagatggtgagggctcctcccaatgggtcccagagggagcacggccctgcagacactctgatctccgtcaaactcctgggctccagaacagacagaatccatttccattgctttaagcctccaggtttgtgatactttgttatggcagccacgggaaactgacacattgaaaatggcaattttgaaaagcccagaaagcaaatatgctggaagaaaaatgttgacttagatgtttcttggtaacctgacttcttagtaactcccagaagtgacttttttgaaaaggaggttactcctgctagggctgaaagttctctgttccaagcttgccttgtggatggaggagctgcttccttgcagaaactctggggttaatatcaggaccctggaa

SEQ ID NO: 1608 - DNA, 7677 bp, Homo sapiens
taaaagtggaaaatctctattgatgtgttgagaaaggaactcagacatgcaggaatctgccaggtccattcgaagtctggtgatggtacgaaaacatggtggctgaattagacaaatgcagttcacactggatgggatttgagagtcatttgctccccataagaattctgaatgtggagaacaaaaccaaagtgactttattatttgcgttaaatatttacatagaggggagtaaacagtgtgtgagacacactatgacagaaatgaatctttctcaaaatgacaagttaggaaacgtatgcattcggtggagagtaaagacgctcatgcatcttctttgcatatgcggtgcatgcaaaaaacaaaactctagacaattctctgtcctcattaaaatccagttacagtaatagctcagccttaaactcgaaacattacgaatgcaatataaatgtttaaacagtttggttgcataattcttcagttcacatttcctaccattggtgacctggttctcaattgtagctggctttctgggatctatttggtaaaagaaatttgaagaatacgctactgaatacattacatcgtatccacattattattattttctttctcccttaaggattaagcttccattttggcagctttgcctgttgggcagaattgtatcagagaattaattgtatcaaagaattaattcagtggatatttacatggtacctactaggtgcagatcatgttgctgtatttacttatagagatgagtcggcctgcaggagctgggggaggaaaaggctgagccaactctagcgtagggtcgacctgcacgttatgagagcaactcaagagaggctttttgggggtctcgagggacctgctctgtctaactcactctggatgggaactgctgggagaaaggagaggctgcagggtggtgctgggtagggtttaaacatttgcgaaaggaaccatggacactgtgggtcgggagatttttggaatactcagatttgagcaaggaaacagcaaggtccacctattcagacatgaggctgtggatgccccaggctgctggaagaattaaaattactcgaatcagtggctcgtaaccatggtggctttccaacagtgcagcttcagtgaaatatgccccgttttgagacttttgagtgttttgttttcctaaatgagtttgcaacatgtgtgagattgtttagcagaatgtagtttcttgagtcagatgcaacaactaaaaataaatacaaatacacatatacacaacagacatctataaatatatacatcttccccaaaggtagtttttctaaaagctagaatagcttttggtaccacatctaattaggagatggtagaacaaggcgcagccatcttgattataataaccgtcttcagataacgtggtgttaaattagctcactcaacagctactttgtaagtagatttgatttatttttagctcttattggaagccaggaatccaaatggagatggagggttttccgggagcacgggagatcgctggccagcagcacgtgaccgggctgctcttctgagaagtttgctgtactttgcaggaggaaattttaagtaaaacccacagtacaggtggagttcactgtgtctcaggcaccaggtttcactttaagaaaaacagacgatttttctaggaaaaaaaagggtacctcctacaaaatacctgacccgtactcctcaaaccatcaaggtcaccaaaaatgaggaaaatctgagcaaccgtcacagccaagaggtgtttaaggacacatgatgactccatgtcatgtgggatcctgggacgggaaagaggcattggggaaaaactgaggccatctgaatgaactctggacttcattaataacaacatattggcacttattctaacaagtgttccatactaaggtaagatgtaaacagcagaggaaacagggcaggatcgctctgtgttatctttgcaacttttctgtaaatctaaaactattctaaaataaaaggctcgctttaaaatgtataaacaagataatttaaaacgcccatgaccccaccgccgggaagacgtcgctgtcaggatggggttgtatcctgctgtctctgtgcgcactgtcgtgcagagtgagaccatgctgggcattcaagtttgctgcgtgcattttcccttcatgttgtacaaacataagcatgcttcccgtgtccctaaaaatgtgtttggtcaatcagtcagtgtgtaaataaatgccacttcagagacattgccgcctcctaagagtggaagtaaatatgcaaatgattctatgtagcaaaacacagaaggtcccaggcagtatgtgtgccccccactgagttgggtcttaatgctcacagtgggggacaggagcctggagaggtccccaccgggtgagaagccagtcctcagtgaccggggccacttctcgtgtctgtgcacactttcagccacacgggtgcccccagccccaacccattggctggctgaagactgttgcggtcggccctgagctcactaatgagaagctggtgactgtggctgggtcacttgggttgggaaggccccctcctgagcagagcaggtggacagtggcggagcccactgtgatgggtgacagaccaggctgtggcagggtttgtaatagagaaccaagacaggggcatgtgttcaggaggacctggtggcaggagggggcatccaagtggcttctaagcagcagtgctgaaggcagggctggcctcaggacaggcagtgaagcccaggcgctgccccacctggaatgcctggctcagcctgggtggccaccgggatttgagcagtttcttcagctgctcttgagcagcacagaaagctctactggcagatagggctggacaaaaatgatgctaacttcccgcttggagcccagagggcaaggagggcttgggctgggttggcaagtggcttaggaatcaggaagctgggttccaccccctccccactctgcctccacagcaccagctgctgtgttaacatcctcagggcaggagcagcttctctcccaggcctcgcccagtggtacatgctcgcagcatggacctggacctgcctgggttctaagccggtctttggaggaggtgtggggttcactgtgcctggttggagcagcaaaccctacacccctgcagatggtagggtggacccaggcacaaaggccgtggcatcctgcagcaggagagccagctgcctgtctgtggtgggtcctctgagacggcagaggacttggggcatgaatgaaatcaccttgtcagggtctaagcagaatccccagctctcagagccccaccgtcagccagcgcctaaactatgcctcctgccctcagagggacccgcccacggagggactcatcctgccccagggaatattaacacgggagaagtgagatctggacaagggcaaccatgatttggtgactccaggaggtgggtgactgtgagctgtgagacaggcatcagtgccacttgctttgtcgagggtatcaagccaggcttcctggaggaggaggaggaggcattcgagatgggccctaagggaagccgagcatgtgaatgttgagcgggaggagggttcttcccagccacctagcagcatggcaagaggagggtaccagggtgggggacaggaccgtcatgccaaggccagaggtgcatgcacagccggcccacactccagggctgaaggctaagccaggcaggcgggagaagtcagggacaggagtggcagagtccacggaaggggaacaacaggctgaatttgcaagatttggctgaggctgcaccagtcagcagacagggtctgggtgtccaatatgacagtccagaggtcacttgccccaccgaagtctcaggaaaacagtggatttccactggcagatgctggtggctgcaagctctctatgcagctggcatctcaggatgtaatggagcagagcctcatattttaggggtaaaaaagggaaagagagaaaaggggtggggggatttttccatatggcgaaggttctcattaaaatcaattgtaaagttagctaatggctggttcatgtcatttggagatggctgtaaatatcagctgcatctatattcagcatttgaaatgttctattgaaagtctatgtaactctgtgagtgttttccagtggagtgttattcatttaaagttgtttgaaaatctgatcagaaagagcttcaacccggaaatttagtgatttgcaatatgccagcatctatgcgctcagcactcccgctcgtggagctcaggaaaggacacccatgagaatgttacttggtgtgtgctttgtgttttgggggggccaggaacgtgcattcaggggagtttctatttgcccaggaggattgtgatgtaaggcacaaggcccgactctggagatgtctggtgcatgggagtttgtgtggaagctggagttggccagcccctgccttagcctctgtcaaagagctggaaggatacgtttactatcggaatgcccgcatgcctgctgggctgatggcatcccataaagaagagagattcgttccacataaaatgcaaccactgtctactgccccaggaatggcccacgggtgtcgggggtgatgaccgacctcaggactaggtagctcccattactgcttggtggctgacgacccatagtgggattacttgggggattgcgttgctggggaattacttgcttgggggattatgaggcgggaaggtgtgccctccattatatagaggaggcaggttgaaaattgtattaggctgttcttgcattgctataaagaaatacctgagactgggtaatttataaaagaaagaggtttaattggctcaaggttctgcagactttgcaggatgcctggtgccagcatctgcttagcttctagggtggcctcaggaagctgacaatggtgggggaaggtgagggggtggggacagacatgtcacaaaatgaaagcaggagtgagagagagagagaaagttgggggcggctgtctcacactttttaataaccagattccctgtgaactcagagcaagagcctaatcatcaccaagggggatggcccatgccattcatgacagatccagacacctccccacaggccccacctccaacactggggattccatttaacatgagatttgctgggggcaaatatccaaactacatcatgagtgaattaggtagaatataccagcagggcgggaccgtgttatccatggagtagcaggccttgccttttggaatgtgtgcgcgttagaatcacctggggagtgtcagccccacttcacaccaccagaaatccacatttaggggccagtggcctggaagtcgtcttacgttttctgcatcccctcctgcccctctaactccacggcttgtgccaggaagaccctgctctgcacccactgccacacaaactcttgtgtgtttcaccataatgcagaattcattttaaaaaagtccttcccctaaagcaaactgctgaggctaaacagtagactcagagatgccctctctgcagctactaagaaaaagatcctcaaagaagcttctctctgctttgaccagcagcgggtacttcccaacactcacttaagtctacttatagcattttacaaatatgctcgtgaatcataaaatatgtgtatgcattaagcgactttgtggccgttttctagatggagaaagaaagacgagagagaagatgttcatgtttggcgagtgtctggcagaggtttaagagagcttggagcctcttaatcagaaacagagctaatcactttgcctaagattaagtcgtcctgggtgccttcccatatcttggtcctcagcattgatttcctgctctgagggcactgatacactaaattgtgaaactcatttttttccatgggtatactgtagaataaatatctggaaaattcttacattcctgataagatccctatagagaaagaatcccctctatctgcccctgagaactgtgaagctcgcctgctgggatcctgagatttcacagtaggccgagaacaccctccatccgcattgatttattcttgtttcctcgcctgcaaggactgtaatcaagcccgtgtgtttactgggatgtggttgagcttgctggctcttaaggatgctgagtagtaaactggggcgaggctcctgtcctgcagctgggttcctgggctgcccggtggtttggtccatggatcctgaacgctctctaatcaaggctgtgtgggcagtcgcctcaccaggtcatcatctctcaagggttaaccacggcagtgattggagtgtgtatgtgagtgtggccctcaaagaaaagacctcgagagttcttatagccaggcccgggaaggggattgtcccgcatggaaaacagtgagacccgatcatttcaatcgaccatacctcttccaggtcgcccatttccacttcataataagcttcatctggtccaaggcctagaagaaagggaggttaaatggctgagtctattaaaacatctgtcgccaaagccccactcacatcatgacctagttctacaagtgccagcttataaaagaccaaaagtaggtcatgggagggagatgaatggggcgaggggaaacatcatttcataagtagtcacttagaaatgttccaacaccggcacccaaagagtcactgacatgccagggcagcgtttccaggactcaccgtctcatttctcagtggtgcctggggacctacagcaggtggcccttgggggccgccgctgatgacaagcacgcacatcccaggagcacgtccattcctgactcttcgaggaagctcatggctgtgagcacaggaagtgaaaattcctgaaagaggaccgacctctcagtcttcacagggacatggatggatttgtgattgagcttgttcagtttgtgtgtttgtttgttttttgggccaattacaaattcagtccatgaaaatctgattgttaacagtaggatcagagcccccgtagagttttgtttttttccattttcaaagcacatgtgccctctaactgcaaagtgtatgaaggaggccgtgctgtcaatgagcagtgcctccctggaaaccttgtgggattttgtcctacaggtaggccgtccattcctccctttccaggcacacacagccagcagctgccattggccccttccatctggcctggagccctgtcctcctgcaggaggtctcagggtctggcccttcctgccccagggacttcctgttgctattgctcaggcccacgggctgtgatgccacaaggctgctgggcgcagggtggaaagggaacatccacggtctctgcaagctggccagcacgactgcgggggctaacttccttctggaacggaccctctgttgactttacacaatgttaacaaagggcctggggcatctgagaacttctgtgctcatctcatgccaacctcacagcaaccccacaggccacatccttgccatcctctccaggctgcagatggaaaccaaggcacagaaggcaccaggccgccatggcgcacggctgtgaaggaggaagccgggcccagaattccgtgct

SEQ ID NO: 1609 - DNA, 4373 bp, Homo sapiens
tgcatttcctcatctgtgaagtgaagtgagcacggttcacagctcagaaggctgctagaagggtaaaactccatgacccaagcatccggtcagtgttccccaaagccgtcgtgctaggccatgctcacctggggacctcacctcaggaatcgggaagatactagcagtcgctaagtggcttactgagagaggtctaaataagtcccacaatttactgttctttcccacaagtcatcctgaaagccatagcaatgactgttggacccaaggtatccaatgaccaagtcccagcatcgggcagacatggagtcagggcttgttggtcactgaatccctctctggaatcacagatgcaccccaggagagaggcttagctcacagcaaggaacctggctttctcccttccccagctccccctgatccagacaggagtgaggatgtctgaagggttgtgtccaccaaatggcctccaaggccaggcagccaggagaccaagcctcagtggccaaacctgggatctctggaatcgagatcctcagcttgatgacagggacaaagagaggaaaagacaaagtcaacttcgagggcaaaaagacttcagaagaactggaccaggggcccagggaaagcagtggtgaattctctgttgaggagaaaacagagccaggtttacaaagagctgcagggcatgtttgcagaaggaagaagagtcggggcattctgagctctagggagccgacgctggcatgggggatagtacagacccgctcggagagcccctcaccgcctgccaggcgccccttgatcccagaaacaccatctgcagaacctgcagcataggaggccaggaaacagatagagcagttgactggggccacagaataactggcaggtgagctgaacccagttaattataatcgcagacacattgtaaggcccagaacccaagttgagcaagaggggcttttgtttccgagtcatggggctagggagattcctgggcctctcgtgttgccctttgaggctgaagtgtctaataggacgtgtaagaatccccacaaaactcaccagggcgggacgagagggaagcacctctcccgagctgtgcatggactatctgtgaggtctccagaggcacccggacccaggcgtgatcctagtctgctcactcgaccgcagggagggagaggcattttgaccaagtttgtttctctgtggatttaattagtatattcattcaacattcaaatatttaaggagtttttttttctttctccatgacatcagaaatctctgacatttgctgaaccagcttggcatctttattatggatttggatgtgaggcgtccacagttttgagcagtctgcgtgatagtttgttccaaagagcgcatgtgggagtcggaagcatgacaaacacagggctatattagggtcaggaataacgatcatctgcttatcatgagaacaaatatcagcagatcaatgaaaacaaatctcaaagcagcgaaaacaacatgattttcaagaggaaaaaacagggtttttaaattttgtttttcaggattgcttttagacttggttgtatgagcagacaccgttcagatgcttgcagcctccacacttcacaaaattaatgtcgtaacagacccaagagttaccatcatgggttcatcttctgagccccgtgttcaccttcagcacagggcagttataccacatcatctgtacttaccagataaggatgccaaggctcaaggagactgtgacctaccagggtctatagctgagctatcacttggcccgagttttccattcgcacatcatgtaaccttgacttctcgtcccacctcgtagggttgctgtgaggatccaacaggacctgaccagctaggaagtgctgcacccacgttagcgcccctgctgagtgctgggctggcatgggccattcactgcacagcaaggcacacttagcccctgcaatatttgagcacttaccgtgtgtctggccgagtcctgggttcaggggttgtagcagggaacagaagagaccgagaccctgcccttgggaaggggacattctagaggtggcagtgggagagttgttaaccagaattgaactgtcgactgggtcagggaacggcggagcaggccaaggggtgggggtcagttttaaatgggacgtcagagcagagggaatcagctggaggcgacctctgcaccctccaaagacgacctggagctgcagaggccagtttcactggtctcattgcactgtcacctgcgttttctgtctggccttgatgtgggggcattactttgggctcatgagccaagaatgtgtgtgtgtgtgcacgtgacttgcagaagcagaaggagaagcacccgtgttcccgaagtcagtgcgttgtggggggtgggggtggcacagaaggggttggagaggatggacgggttcactgcctaacagggacagggcagaagctcctctgtgagctggctggcgcccggccttgccagtccattctgctgggtcaggcctttttccacgcccgggcttagctaacgtgggcagcaggtctgcttctgcacccagcagcaggtggtcctggagccggagacagcttggttgctcgtgttgagtgaacaggaaggaatgtgtaacttgtcacctccacctatagattttagaatgataggaaggcagccattgtaactcagagcctcctgaattttttaaattgcgctcgaagggtcagaagcactgaattcaggccagagaatgagcaactctagaaaacatgtttgttttctgcccttgcctcctggttctttgagagccactgaaaatcagggcttcagaatcctcttccgaatcctgtaggagggcggaccctaccctggctcacacggtggcaagaggagcctcagctccaatcactgaaccagacaagctttaggggaaaagagtcagaagaagcgtgttttggaggagggtgggtgggtgctgagaaaggcctatcagctcagcggcttctgggggcagcaggagaggggcacacgcatgataaattctgtctagacacaggttggaggacccgttccaggggtgtgtcctctggggatcaggccagtggttcaaggtgagcaaaccagggaaccgtctgctggaaacctgactgtgccagagttccacccagaacttcccagggtgttggtggcacttaggtgccagcctgcctgccggcttcaggcccgtgggacagcagggaacactcaggtctcccccttggcacagtgaatgctcaagacgttctccgctcattggctggggtggggacctctgtgctctgtggggtgttccgcagcctccccacctccacccctggggatgccaggagcaccctgcccctaatgtgacaatcaaaaaggtcaccagacatcgccaagtgtcccctgcggagcagatgtgcccgcatggagagctctttgtgtcgaccatgactgctttttgtttttataaatggggaagcggacgggcagagagggcaccccaggaaggtcctttgtgtgcctggtagagctgaggccccctggttgggacagcagtgcctcccgccccccgactcgacttgaggcccaggcacttggtgtcatgcaggggtgtccagacggcctggtgcaggatccctttgatgtggaggagggtgggtccctgcccgctagggtggggcagggtggttctgtgagaggcggccacttctagcccttcgtcctttctcccttttgtgtcggtgtcccccagcgaggcccaggacttgttctcacccctcccttccctgcaggccagccgcctcctgggccccctggccttccccatggcctttcaggggtctgcgccctacctcctcacacagcacaaagccaacgtgccccaccaggaattcccacctcacccctgtggcccagccattctcccgtgtggggacgcgtggacacaaccctgaggaggctgggtttcttctggcatcgccgcagacatcctcctgctgacccaagccccgaagcccgcagcttcctgagctatttgtgtctcattcacatgtgcggtttccccttcccaggacccccggctgctgcgtcggcctgaaaacacacacaggtgctgaggtctcgtagagatggtgccgcctgccgtgccacggttttcctcactgccgcccccacccctctgcacatggaaccgggcacccccacccctgtgctcagccggtcactgctctgtcaaagcgacttcagggatcacctgcctgcagctggcttccccactgcactttgggtttgccagctcattcattcattcattcattca

SEQ ID NO: 1610 - DNA, 2095 bp, Homo sapiens
acttcttaataatttttgaaacaaggggatccacattttcactttgcactgggcctctgaattaagtagctggtcctgctcctcatatactatcctggggttagttgattctttgcttttactgctaaaaacatccaccaaaactcagccaggcatggtagctcacgcctgtaatcccagcactctgggaggccaaggctggcagatcacgaggtcaggagtttgagaccagcctgaccaacctggcgaaaccccgtctctactgaaaatacaaaaattagccggcatgcacctgtaatcccagctactcaggaggctgaggttgcagtgagcagagattgcgccactgcactccagcctgggcgacagagtgagcctctgtctcaaaaaaaaaaaaaaaaaaaaaaagtccaccaatagttgctttgtcaatagatggccttaaaccattgaagaatcaaggagtttggaatcctggtattgttggacttatagacttgtagtactagagtacagagaagcacctttctctgcttcctctctccagctaccaaggagctcagttgctcagctgaggaggtaagagcagcaaccagcctggacaggcttctgcactcctggtacagtccagggaggctcaccttgctggtggtatttccctgccagccctcacaacttgaacttcccttcttccaaaccagaaaggaaaaaaagggcaacaggaaaggccaggtctcctgactctgctccatggtgagccctttccaactgtgtgctattttgctgttaccatggtgatcagttgctctctactaagtcatttttttacctttctctttcttcagtggaaatttgcattttagaacttctccccaaaacctgttcttcttagcattccttcttcacttctactactgtatgaacagacttcctttttagatttaaaggcgctaaacctccctttagtagttttatacttactttgtattagtcagttttcatactgctataaagaactgcccgagactgggtaatttataaaggaaagatgtttaattgactcaaggttcagcatggctggagaggcctcaggaaacctacaatcatggcggaaggtgaagggaagcaacgcaccttctttacaaggtggcaggaaggagaatgaatgcagaaggaactaccaaacacttttaaaaccaccagatattgtgagaactctctcactgtcatgaatatagcataggggaaattgcctcaatgattcaattacctcccacgaggtccctccctccacacatgggattatgaggattatggggattgcaattcaagatgagattttgagtggggacactgccaaaccatatcaatgatttacctttttattctttactttattacataccctcataagaaactgtagctgaaaccttaacatacttggtcaaatacttggattgaataaggtgaatattgagtttgtatcaacaaaacacttctcgtgtaatcagcatataatttgaatagctataaagttaagatatacaatgaaaagatttgtagaaaatagtctccatgaaggcatattgctcaatttttatttatggagttgaaatttaagtctacacatctctgtagcaccccaattaaaatgagagaagaaaaatggagagataggaactacatgtagtttccagtgtggaacaagtggatggtatttattaacggtgacaaggaggatgatatttttaatattttaactccctgttgataaaagtgaaagagtctaaagtttagaaggggttgttagtgatttagtgatgacctaaacaagcaaatgtggacttttcaatgaaaacctctttgcaggggtggttgaggtcatgttagccagtaatcttttgccagggatcttaggtagatatccattcaacatgtatttttttcaatacattttaattgagtgactactacatctgaattattgttctgggactgtgcttgaactgttcagatacagtttttaccctcataaactctgtctaccgaggatgtcagacaataccagaagaaaataaagggatcaagtatcaag

SEQ ID NO: 1611 - DNA, 1591 bp, Homo sapiens
gactcctacagctgattttataaggaactccctaaaatacataccaatagcttaagagatttgtcagtaaacaacaatgtcatgtgacagcaattaatcaacacaatagtaacgccttgtttgctcctgtgttcaactgtcaaaggaggccatttcatctggactattaaaactcctaaatgtggcctggtttatcaatggtaaagtgaatcagggagtttttgacgaatacaaatagaaaaaaaaatcctgtaatgtgaatttaaatgcatgtacttagaggctgtaatatataaactacagcatacagataggggttggaaagccatagtttgatggtacaagagcaaatgcttaaatgatgactgtataaaaatgctggaaactcccccagaggcaaagagtaaactggaatgtcatattgcctgccactgtacacaagagatgaagggaccagaaaataaacacaggcttcttgaaattcatcacaggatatactagtaaaggcataaaaactggaagtcaaaagtcagcagcaagataataagcattttggaaatagggtgttcagtagagagggtaaccatagccagagttgtattacagccatagcttgagctgtagtcaccaccacttatatggagccttaattacagcccagtcctgggtagcttttgctacccacatcatagccatagccaaggccacatccacagttcccatacgagtttgtgtcataattggaatacatggtgtcagcatgtaaggtttcagttgcattgtaaaggaagattgatagtctattcagagcaccatgccaagacctgcacttcacctgccaggaacaggcaggccatgtgtcatacagactctgcctcctccatacctccaacagtttgtggagcagcctttcattattttgtggtgtcctcttagaaaagatttggtcaaagcagttaagaaagtgtttaattgatctgctaacttggctttccccaactaaattttcagtctaatataagtcatttttgatgaacatacttgtcagattttattatccataactagcagcatgacacctactgtgaaggtgaaggtctcaggtgagcacctgtccacatgagagctgctataacgaacccttttgcctctcttattatcctgttattttacctaagaccataacctcaacttcttcctcattgcaatttaacgcattacatcggccaggaagctatattcccattaacacataaagccacagaggcagaattatgtctgtgtctacccgcattcaaaacaagacataattggtgattaggccacctctgctaccaaattcatagttaattcatgagaagagttaacccgtgtattaaaatctatgttctagactaggtgtggtggctcacacaggtaatctcaacactttgggaggccaaggaagggattgcttcagccccagagttcgagaccagcatgggcaacatagggagacactatctctacaaaaaatttgaaacttaaacagacgcagtagaggtgaaaggattgcctgagcctaggagtgtgaggttacagtaagctatga

SEQ ID NO: 1612 - DNA, 1566 bp, Homo sapiens
caagcaattctcatgcctcagcctcccaagtagctgggactacaggtgcccaccaccatgtccggctaatttttgtatttttagttaggacagggtttcaccatgctggccaggctggtctcgaactcctgacctcaagtgatccgcccactttggcctcccaaagttctgggattacaggcatgagttactgtgcccagccctcgctttaaaaattaccaagcctcaggtattgctttacagcaatgaaaaaccgattaacacagtactttgccagaattattaaaaatgaaaaacgaatgcaacaggctgtccactgacgtccacttctgaggctgcttttgaggcattactattccatgagctcaacaccaccctgtcctccccagcagcatcctctgcctctgcacccagaacacgcccaagagacatggaggctcccagagctgaatgcagtcacatcgagccttataaaacctgtgtgtgtccaaactgctggattccacatgaatgtcgggaatcctctccaccaccactgagaaccatggctaaagtatatctgaattttttaagagaagaatttcagtacctccttggacttcagttgtttgtgaggactgctaaatagccattttctaaagctgagagtgtctgtttgaatgtggagtatcataaaaagtcacttaaggagtggttttaatggaaacagaaccagcactcagaatgccctaaatctttcctgtctttaccactgactgttatactatataataaccatatggcctgcatttccaggagagttccaatttcatgtatcttattacattaaattaataaataggcttatactgattcttaaagattttctttttttaatattttccaaatgttatacaataaagcacgttttttcataatcagaaacaaataaatttcatttatatattatgtgaatatacatttatatttatattctgtgcatacaaaaacccgcatgtgaatgcttatagcaattttattcataattgctaaaactaggaagcagccacaatgtccttcagcaggtgaagggataaataatcaatggtatatcacacaaaggaatattatccggcactgagaagaaatgagctagcaagccacagaaaaatatggaagaaccttgaagacatattactaagtgaaagaagcccatctgaaaaagctacacactgtatgactccaactacacgacatcctggaaaaggtgaagctatagagacagtaacaagagcagtggctgccaggagatgggggaaaggagggatgaacaggcagagcacaaaagatttttagggcagtgaaactaattctgtgggatactatgtggtgaacacacgtaattatacattggtccaaacgcacagaaggtacaacactgagagtgaagcctggtgtaaactatgaactctgggtggtgatgacagttgaatgttggttttctgtttgtaagaaatgcaccagtctggggcaggatgttggtggtgggagaggtgggccaggagtgagagaggaaggggcgtacag

SEQ ID NO: 1613 - DNA, 2965 bp, Homo sapiens
ataatttttaattattaagaaattattgctgggcccggtggctcatgcctgtaattccaacactttgggaggccaaggtgggcggatcacctgaggtcaaaagttcgagaccagtctgaccaacatagagaaaccccgactctactaaaaatacaaaaaaactcagccaggcatggtggcgcatgcctgtaatcccagctactcagtaggctgaggcaggagaatcgcttgaacccgggaggcagaggttgcggtgagccgagatcgcaccattgcactccagcctgggcaagaagagtgaaactccatcccaaaaaaaaaaacaaaaacaaaaacaaaaaataataataattaatcatgtccccaccatgaaactattaaacataattgtttatcgtcagggagcccttgttcctgggctgggcctcaggcttcccatcagtagtaaatgggccaaaccaccagttctctcaaaggaggcttctaacacgaatgttccacaacacttgtaaggcccatctgtccaaccgaagcagtcctttataaagttctatccaaatgggatcactggctataacatatcaagaattggaaatagtgatgaccaggaagtttcttttgatttgaccaattaaaacaacatttttttctcatatctaacacttattctcatatctaacactaccccgtatttcaatgtcataggtttttaagctacaaccacaaattctgtcgtttaaatttaggagcaatcacaataattcaccgaccagctataaaataaatttttagcacattctcaatcattctcaataaactgtcatcattcacggatttcaacagcacccaatgccatgtttttaagcagcagtaactcctctgcaaagcaatatttctctttgcaacttatcacaccttacaaaagatacctgcaaagagaggtaaatcaaacaaaacatgtaagttatgtttattttcccattacaaacggtatcaaagtacagagctacagcatcgagacataaaaaggatgccctgaaattttactgggtgcaattttcactaaatatagcctaatgaactgaatagttcaatgcttttgcagaaaaagtcctaagcagtgcaattaagaaaaatctaaaacaacacaatgattttatataagcagcagaaatcttcttcccaaatgagaacaagtcatatgcaccactcatttaagactcttcaaaatgcagaaagatgtctggattttgaaagtgaggaaggaagactaatagttcagggcagcagcatgaaatagcaaaagctcccagacatcagggatacagcctgaagcctccaggctcaacctagctgtttactaattgtgtgactgtgggcaaatctcttcatctctgaacctcagtttgctcatcaataaagtggagataatagtacgtactcagtggggcaagatggctcacccctgtgatcccagcactttgggaggccaaggcgggcagatcacccgaggtcaggagttcgagaacagcctggccaacaaggtgaaaccccatctctactaaaaatacaaaaattagccaggcatggtggcctgtaatctcagctacccgggaggctaaggcacaagaatcacttgaacccgggaggtggaggttgcagtgagctgagatcgcgccactgcactccagcctgggtgacagagccagattccatctcaaaaaaaaaaaaaaaaatagtatgtactctgcctgctctgcaggcatgataattcccaatgctcactccagcctgggtgacgaagccagaccccaactcaaaaaaaaaaaatagtgtactctgcctgctctgcaggggtgataattaccaatgctcaggtgaaaaaaaagctaagactcaggatacacttccaagactagtgtgtcaggccacttttgcattgctgtaaggaaatacctaaggctgggtaatttatatagaaaagaggtttaattggctcatggttctgcagattgtacaagaagcacggcttctgggaaagcctcagggagcttttactcatggtgcaaggtgaagtgggggtaggagtctcacatggcagaggaggagcaagagagagtagagggaggtgtcacactttacaacagccagatcttgcgagaactggctcactatggcaagaactgcaccaagccaagagggatccgcccccacaacacaaacacctcccaccaggcccctcctccaacaccgggagttaatcttaacaagagatttggaggggacatccaactatattagctagtgaatcccagaacctggactcaaaagtatattctcttgctagatggcaaaaagcatttgctggtgaagggtttgatcctgagagctttgaaatagaaaaatggaaaatctaatgggaaatcaggaggaataatcagagtttactctctctctgccaagcttataagcaaaagagctgaagtgtattgaacactatgcccaagagttttatatccattttatcatgcaatgctcctttagctagataattacagcaaaaacttacatagcatttagtgtgtgccttgtaccattccaaacttctatcatgtgattcatctgctcttcccaacatctcagggaggcagacacatccttgtcttagtacatttgtgctgctacaaaggaatgcctgagactgtgtaattacaaagaaaaggggtctatttggctcatggttctgcagactgtacaagaaaaatggcagcaacatctgcttctggggaggcctcaggaagcttccactcatggtggaaggaaaagggggagcgagcatgtcacgtggcaaggaggaggaaaagagagaggggccagactctttaataatcagatctgaggctgggcgcggtggctcatacctgtaatctcagcactttgggaggccgatcacctgaggtcaaga

SEQ ID NO: 1614 - DNA, 2216 bp, Homo sapiens
tctctactaaaaatacaaaattagccgggtgtggtggcgcatgcctgtaatcccagctactcaggaggctgagggaggagaatcgcttgaacccgggaggcggaggttgcagtaagccaagatcgcgccattgcactccagcctgggcaacaagagtgaaactactctgtctaaaaaaaaaaagaaagaagaagaagaaggaggaggaggaaagaagaaaaagaagaaagacaccacagctgagtatttggagctatatagataccccttcccttcgagtttcttcctgttttttttagttgagtaactgctgaattgaattgaattctttggttggttagcaaagggtcatggaaaaagtgtcctctcttctcagaggcgtttctttaaaaaaaaaaaaaaaaagaatgggaaaatacattattgagatttccaagggtttcatttaaaagcctgtgagtaaaggagaacaatggttatgaagattcgtatcaaaaaagagaagggcccaaggcagggtgcaggagcgcagtgcctggagcctcagggcagagacctcctctgcttgggaaaggagccctttctgactgccctccacatatcccgcattaatccatggctgtgactccactaccgtctataggtgcccttcaatagctacattattcattcctttcagcatgtaagttaatttttccccgtctaaaacaagtgctgcttttatcctctcaaaactcatggtatgtaagaagcaacattccaggccctgttattgcaaatgatcagtcaagcctcagtattctaatgtataagctggtagctgaaaagtgtagcaaaccacagctagccagacattttcccctgtatttacttctcattcctgtgtcatttctctggccagctgatggaaatctaaaagatgagtgacttttccttcccctcattcattactccaagataattcctgactgaaaatgcagaacttggacattattgtaattcatttttaatagccagctagaccgggtgtggtggttcacgtctgcaatccctgcagctggagaggctggggtgggaggatcacttgagctcaagaattcgacaccagcctgggcaacagagcgaaaccccatctctgcaaaaaaatacaaaaatgaactcagcatggtggtgcatgcctgtagtcctagctaatcaggaggctgaggcaggaggatcagatgagcccaggattcaaggctgcagtgatctaggattgtaccactgcattccagcctgggtgacagaataagaccctatctttcaaaaaaaaaaaaaaaaaaaaaaaaaggagccagctaatacaggacaaaataattatctctctctctcttttttttttttttttttttttgagaaggactctgtctgtgtcacccaggctggagtgcagtggtgtgatttcggctcagtgcaacctgcaacctctgcctcccgggttcaagcgattctcccacctcagcctctcgagtattgggattacaggcacctgtcaccacatccagctaatttttgtatttttagtagagactgggtttcatcatgttggttggtcaggctggtcttgaacccctgacctcaggtgatccgcctgcctcagcacccccaaagtgctaggattacaggaatgagccactgcgccctgcccaaaataatcctttctgtcgaaaaaaaaaagtgtttcatgtaataaacactggttctaatcctaagagaaaatatatagaaaacagaactcacaggtgtttcttgaaagtaggtcacatggcaccaagtggctgagcacagaacactacacttatcttgattgtctgataaatagtattttgaattttgtttctacttgaccgatctactgtctttgcttcctattgctgctgtaactagtgactacagtagtggctgaaaacaacacaaatacaccaccttaaagttctggaagccacaagtccaaaatgagtgttccacgctaaaatcagggagtcagccaggatgcgttcttctggagttacctagcccctgtgttcatcttctgggcaaccaaaagattttgactaatattcaattatttgagcatggctactaagttaactctcctttgttttttgttttgttgttgttgttttgtttgtttgtttgagatggagtcttgctctgtcacccaggctggagtgtaa

SEQ ID NO: 1615 - DNA, 2040 bp, Homo sapiens
agctggtggtgtaattcagtcctgggaatggaggtggtgggaggatactggcgtcagttccagactctaaaggctcgagaaccaggagctccaaagttcaagggcaggaaaaaatgaatgtcccagttgaagatgagaaaacaaattcacccttcctctgccattgtgttctattcaggccctcaatggatgggatgaggcctacacacactgctgagggctctcttctttgctcagccgaccaattcaaacgctcatcttttccagaaacaccctcatagacacacccaggaataatcttttaccagctatctgggcatcccttagcccagtcaagttgacacattaaaattaaccatcctacagggatttcctaccgttttggggaagccatcttttcatggcttccttccagaggaaaattcctgctatatgcttgacagaaagaacaaaaccccaaacatacaaaaagaccagtctgtggaatgtagacaatttgggtcagatgtggttccctgcctagaggagccagtgagatgagccatttccatccaccaaagatgggcttgaaatgtggtctacctttcaacatggtgccactgagggcttctgagctggctgtgatcatctgacaaaacgctgtgttggccaactcatagaagagtttgctagctggcctggccccaagcagaagcagcaggttactgcccaaattctccaagtgggatgaccagcggctatataaagggcaaacaaacaagaaagcctttctttctgagaatgtttccactgcagttaggttagaaaatgatccagggaagatataaactagccctttcatttagcaaaataaaatgcctatccgcttggtaatctgtgcagtggaagtcagagccagagtcttgtttttaaagattttgtttaattcaccacccccatacctcccctcccactgcctagcatcaggctggacaagaagaaaagggacactggcctgcagatgctgccacgtgacatgtccttatagaatagcttctgtgacatttgtattaagtaaccacaggaaaaaaggtgaggtgttgatgacagaaggcatctgtattttctggggttgggttccagttttaatgaatatggataatgcacaaaacatctcatttttcggagctgtgttttttcattaaacactgccactctgcatgggaaaggaactggacattcctgacacattatttggcaggtctcaatcgcaagtgctccaatattggctttcggaaacccattccagatttggcccagattgtcaaatcttgtccagagcaccaagtcaaaaggtgcctctaagccctgggcagagtgccaggctctgaaaaacactggctggatctcctcagggaccctggctgagacaggcgagtgatttgttcttcaaatgacctttccctccttggaaaagagcacccggaataaaagtgcaagatgtgcttcagatgtcccccaagagtttaacacaagcagaggtattgaggggcttctgtgtattgaccaaagaagaaacatttttttggctgggcatggtggcttacgcctgtaatctcagcactttgggaggctgaggcgggtggatcacctgaggtcaggagttcgagaccagcctggccaacatggtgaaactcccatctctacccacaaatacaaaaattcgccaggcatcacctgtaatcccagctactcgggaggctgaggcaggagaattgcttgaacccgggaggcggaggttgcagtgagtgtggtggtgggcacctgtaatctcagctactcaggaggctaaggcaggggaatcaattgatccgatcttggctgcagtgagccaagatcgaaccactgcaccccagcctcggcaacagagcaagactccatctcaaaaacaaaaacaaatgaacaaacgaacaaaaagaaacattttttccctgtggtaggatgtctgccctcaagcagtgaacccaactactgtagaactggtggcacctgtccaattaa

SEQ ID NO: 1616 - DNA, 1893 bp, Homo sapiens
taaagaccttttatccttagcgtcaacaattgttgaaaaggtggatttggctacatgcacactcacacacctgtgtgcacacacacccatacacacatggttttagtttatttactcatttattttttggtgacaagcagcctcccctgctgctgcaggcttctaaccactctccaggctcattcttcccagtgctggagaaagtggctcaaggactctgtctcatcttgtgggaggaggaagggaggatgaattcaaacaggatttgaggcctggccccagttttcctgcaaggatattatgctcttgaattatcagtgggattcagggagcttttgcttttaacttaccatcgtccatgtatagaatcagaaaacatggagccgaaggagtccacggaggtcagctgctgctcatctttcctcatttgacagagaagaaaactggaattcagggaggtgatgtgactttgccaagctcacttagccagtgctgatttttttttaggtgtccagctattttgcagacatccaaatctgggaagcagggaacacatagaaagagtggtccccagagagaatgagaaccagtgacatgaacatgcttcttgaaagatgaagaggcaaaactttgggtgccatgttgcccctgtgacttgtagctgcaggggagctgggtgtcaggcttactacctctgaggggtgaggggccaggctgaggtggttcccaggctcttggtgctttctgtcgggagtccaggcaggcagagggttgtgagactatctatgcttcttgtctaaccactctgggttttggtgtcctactttggcttggagtccaccatgaagaattcaccataacctgctcttcttgcttttgaactcaccaagggatgagacacatgctcagggtgaatgaaaaaatcgtatttaaaataatcctttcttaagtcatacccaatcttacttcatacaatgtggatcttacaggattcaacaattagtcaaaaagtcatgagctaacaaaataggagctttctgccaagaacccctgtgctgtggattttggggttggaatcagttgcttgatttatggggatcccatccactggaaatgcagaaccatgtgccagagtggtggagcatcattcctgctgaagatggcttggaggaaagcctgaccaagctgcatctgttttgcagattaagagagacacacacaaaacaaactgttgtgtccctgcacttccatggcctgtgatggcctaagcaaagccgtgatggctgagcattaacatgcagtgaatggaacttggccttctttggaaaaaatcttttttgttttgaaaaatatttgaacaccatattcagaagttcatgactaccgagagggagttttgggcaaataatcagcccctatccccttttcaggatagattttctgttttaatttccaacaacaaacagcacgaacagaatatggacatgtattgagagttttctatgtgccagacactgttctaaatgcattacctattgttttcttcgatcctcagcacaatcctatgaaataagttcccatttacagatgaggaaaccaaggctgagagaagaggttaagtaacttggctaaggtcacacaataatgaaacagcaaagtcagattcaaatacaggtagtctggtgcccaaatgcacactcttaaccactattctttatgttctcttaacaaattcgtcattctgttgtaagtgagtgagtgttagaggtgggatgtgcctggaatgcagattcctaggtgattcttcttgggtgtagatctgatatgattttgccaacttctaagccaatgtggggcattcaggtcacaggactggatctgtagtgtgttgtt

SEQ ID NO: 1617 - DNA, 2250 bp, Homo sapiens
tcagtcagggctcagcaggaaacacatggcacatatataattgggataatttgaggagagtttagtaaaggaattgtttacaaaggtgtgggcagggtgtagggaacccacacaggagggtataactggggtctagtgtcagcgggcgccatcatcattcctaggccagatgagggaaggttaagagttaatggccgggcgcagtggctcaagcctgtaatcccagcactttgggaggtcgaggagggcggatcacaaagtcaggagatcgagaccatcctggctaacatggtgaaaccccgtctctaccaaaaatacaaaaaattagccgggcatggtggcgggcgcctgtagtcccagctactcgggaggctgaggcaggagaatggcgtgaacccgggaggcggagcttgcagtgagccgagatcgcgccactgcacttcagcccgtgtgacagagcgagactccgtctcagagaaaaaaaaaaaaaaaaaaaagagttaaggggagaaggtgacgaggtagacaagatccttggctgagaccttcagtgaagggatgcagccaatcctcagagaccctggcaggcaggagcagggggaataagtacgctgactccatctccccttcccctgatttccttctgggcctccagttggcagaaccaaatcggaaggcggagggcaagacagtccattgaagtccacatggggagaagggtggagaggcaatgtgggggttgcggggagcaccaaaagaagatgcccgacagagatggctagcacccccgcccccaccgcacaacacactcacgacacactcacgacacactcacgacacactcacgacacactcacaacacaggaccagagagcagatctctactttctaaggatcttttcaggtctgacctgcagattcttccattttaaatcaaggctaaaatatattgaggcttactgaggtctagtggcagctcggagttatcagtgggttgggtagtgcttgctgctctggaactaatggcacaattttattgcatttaggtcaaattgtgcctcaattccaatgtcgtatttttgggtcatgggtctcctctctctttcttttctaaatgtgcccgagtattcctcctggtcctttgggatgctgacagaggagcagatatgcagcatctctgccatgatataagggctgctgcagtgcacaactgtctcccaagaaggtaccgcaggggtgtaaaacttctccctgcattgtcaacgctggtctccatggatgtctgctggctttttcaaaaattcttgtagaacagtgcttctcatatggtgattttgtcccccttgccccagggggacctttggccatgtcttgagatgtttttggttgccgtgattgaggaggtgctaccagcgtctgctgggcagagaccagggatgctgctccacatcccacaatgcacaggacaatcttctctacagcaatgaattatccagttcacaatctcaatagcaccaatattgagaaaccctgttgaagatggagactatccacggggcattgatcttggggtctcccccttcctgaatacttgaagtccctcggcagactcttggatacctccagcaatggggagctcaccacctgttttgaagccaggcaggtttgggctcttcttgtagctgtgtgactctggattttcccataggtgggagtggatccaccaccttgagcttcagtttcctccagtgccatgggattagcagcagccctgcctcacagattgcgtgaggatgaaatgagatgatgctcctgagttggctggtgcagtgcacggtacacagagagtgctcaataaatgttccctgctgtgaatgccctgtcctggttcactcgcctacattgcggagcagaggaacttcagggtttcttttgtctccaaaatttcaggattctagagagatgaagcactgagtgaagaataatgtgtaggtctttgggagaactttccccttaggggttgttcctctgcaatgtttgctcatgaacattttgggtgaatcatctctgtgggtgttggaaggagaccttctagcatagttttatgatagtctgtgaagggaaaatcggaattcctaaagaaggaagcagtgggatgtcagttaagttgggaagctgatggctctcagggccaccattcatcacatttcattgaggggcagctctacttggctgccaaagggtgggcct

SEQ ID NO: 1618 - DNA, 1928 bp, Homo sapiens
atttaaaaacatctattggcataataaactccaaatttaggctggtggtaggaggataggagggaaaactgagattagggttggcacacagagggtgattctatctgcagtgtcttgttcaagaagaaaaaaatctgcagcaaagagaccataaggttaagatttttaaaagctggtgtttatgatattatctctatctttatctgtatgttggaaacacttttcattaaatcagatacattattactaaatatataatattaatctacaaaatattaataccatgtaagatttacatactgcccaggacacagtatgcaaatgagttctagttattgttattattaatactaattgcctattgtatgccagattctacatccaagggctctggcatgctgggtgaatcacacctagaaaactaaatccaatccagacactgtagatgcagctgtcgcatagtgcttggctcagagtaggttctcaggaaacgcgagcttttgtaattttcttaaaatgctcgaacgtcactaagcatgctggctttggctaaacatgtcagcccttctgggtgtcccaatctaaccaaaccaacaaacaaagaaacccagaaaaccaggcattgaagggagtcacagaatactgctcctagcttagccagagagcctggcccggtgaatgattccatttctctggacacacgcacagagtacccaacaaccaggctgctcatgacaacgggctccagctttaacaaatgtagcactagcactatttattttccaaacgtggttgagtttcgactcaaggggatgcagttaggaaaaataatgaccaggaaacacacacacacacaagcacacacacacacatgcacacacacgcatgcatgcacacattggctcacacagaataagacaacggcaaccagacttcctgggttaggaggggcaggaaatggaaaagataaacataaagaaaaggagcttcttttgtatcactttaagaggaagaaaaaagcccatcaggcatgcatgcgtgtgtgcgcatgtacgtgtgtgtgcatgtgcgtgtgtgttgaaaggacagcaattgagtgaagagggaacaagtgtggtttgcttagaagacgaggggacttccttgacaccagcccataatccagccaccaaaaaggtgctttctgatttgcgttgcacaagttggttgatcataataagcacacatttcattttaataatgtattgggcaagaacaagggttcctcagccccattaaaacagtgccccagcctagcatagcatgctggatggaatgctatttctgggctctggtgaaagtggagcagaggaagtaattgtgccgctaattgctccatctcgggcttggtttacagtgatattaatgccctggtctccagtagatcagcttcataaagagagagagagaaatagcagcccattagaatgggaacaggagaaactggagcaggtgggggaggttccatgcttgggtctgctttgccggttgaatttcgctggtgaaatcttgtgggatactgagggggtttcttctgaagccaatggcatttgaagcctctgggtttgagatcaggctctgccattttcaaactatgtgctggtccccctctgaaactcagtttgttcatctgcaaaatggagctatgccatctgcccttagggtgacaatttacaatgaagagtgtctagcactgtgcctggcacacagccattcatgctggctggccctaattttcaaaggaaagaagaaatgagactcttcaaaggcaagcagtttggtaaggaaggcaaaatctcaaatggggactaatggaaaatagctcaggattggggaaggctctgtaagaaagggagccaggtgctgctgagggacttgcctgagacagc

SEQ ID NO: 1619 - DNA, 1673 bp, Homo sapiens
caatcatagttcactgtagccttgaactcctgggttcaagcagtcctcccacctcagcctcccaagcagctgggactacagaacacatcaccatgcctagctactttatcttattgttttagagatgggatcttgctgtattgctcaggctggtctcaaagtcctgggcctcaagcgattctcctgcctcagcctcccaagtgggtgaggttacaggcgtgagcattctttacccttataaacattacaaagctgcagtaagaagtgatgttggtcccttgatgttcacttaacaagatttcagtgaaatcaactgatgcccagttgagaaaacatgaagtggattcagtgttgtctgagggattaccccaataaaaatgagtcctcaattagccaagaaagatttggttatatttccttcacttttcgtaataaagaaaggaagttgaatttttttaaggaagatttttaacactagcagttactcttagctgactcagaaatttacatatcctcaaacaacctgattccaaagcactgaaaattgattcagttctccagttttctcagagggaccaagaccttctcagtcagagatgtcaccaaactcagacagtacggctcactcaactcaaattaacccaattctacctcatcctgcagtgtccttttgccatattctctggacttccttaaatctaagcaactcatgaagacggaactcacagactcaaatgtctacgagataggcagatggtatgaagaggataaaggaacagagcgtccaatatgccaaattttcctgcctttgaccactgtgcaggctgctccctccacctggaagtctgcttttacttccttccagaatggattttctcaaggttttatgacattttaaaaacacttatcagaatacaagcataaaaaaagagagaacatacggattcagggcttacctgtgtacaggatgcggctgatcatccccggcatcaccatgaggaacatgggcagcagcttcaggtaagcacacataatgcaagcggccttcacgtgagacatgtccttgccacacaggcagcgctgcacaatgacctgccgggagaacgtgacacactcatgaaacaagccaggggatgatttcaaaggcagtcagcgtccctttccagagtttaatgttgcaataagaaataatgtggaccagtataccaaagagctatctgcactcctgtgttcattgcagcactattcacaatagccaacatgtggaatcagcctgagtgtccatcagcggatgaatggataaagaaaatatgcataatacacaatgcaaaaccattcagccatacacaacaacgaagccctgtcatttgcagcaacatggatggaaccggaggtcattaagttaagtgaaataagccaggcacagaaagacaaatgtcacacattctcactcattctcacttcctgaggcctagcttaggaagatactgaaggctttgatttgccctgaaggacggaataaactaagaaagaagacaataggcaatactggaaaaaggagaaataaccggagtagggcaaaaatgaattcccaaagatgatagcgaaggggtcattggataaggttgggcaccagagggagtgctgccagactgtgagagggcaaagactcc

SEQ ID NO: 1620 - DNA, 4066 bp, Homo sapiens
tatccatgggcaggatacaggggagcgaagtgtattctgaatcaggggactctggaaatgatcttgtacgattgagcacctccttgtcctggctgaggctatctctaaatttgaaatcatagtcaaagccaacagctaagaaatagtctttttttggtacagttcatgactattctttattattgggcctttaccgtctattaggtcccgtgccaagcccggtgcctctgtcatttcatttaaaccttacaactccgtgtctccagggcctggaacagtgcacaataatggtcaatagattaaatgaatggtcctggaggtaggtactattattcccgttttatgctttatggagattaaataacttacacccaagatcacagagctattgaatggcaaccacacactttacctgtattaactctcatacttctcacaaccttctcctgaagtagtctttattacaccattttacagaggaggaaatggagtccaagagaggttaagaaactcgcctgagatgccagagctaattagtggcagcactgggatcagaaccagaccagctagtctgactccaaagcctgtgatcctacagtctgtctagaccaccaacacggggtttgtctctgatttctgtatttgctgtctatgcagccagccccgagcagctccaggaagaggcacattcaggcaggggatagttagagaggccatgttgttctggggagagtaatttggagcccccgtgttccctggttcttctcagggatgttccactgatctccacccacttgatccttttcctgctgcatctctctgatatcacccaagaccaaaccagctcatcttgaaaagcctggggagcccaggagtggaggagccagctggggcagcctgcatgggaggcagggctagggatcctactgccagagcccagggctgtcatttcaacacagccttggctcctctgcaaagtcttgcctcctggtttggctgctttaaacctgagtgaggcccagcccacctgccttgcccccagcctgctcactgcctgaggtttgctataacaccccatgcaggagacaccctcacttgtgcttagaagccccctgtgcttggtttaatgccttgccatctctatcttaaaattcttgaccaggcacggtggctcacgcctgtaatcccagcactttgggaggccgaggcgggtggatcacctgaggtcaggagttcgagaccagcctggccaacatggcgaaaccccgtctctactaaaaatacaaaaatcagccatgtgtggtggcacacgcctgtaatcccagctacccaggaggctgaggcaggaggatcactggaacccggggtgcagaagctccagtgaaccaagatcgtgccactgcactccagccctggcaacagagcaagactctgtctgaaaaaaaaaaaagaaagaaagaaaaaagaaattcttaatccttttgaaaagaggctctgcattttcattttgcagtgggccctgcaaattatgtagccagccctgctcagacccagctaaggcatcagagcaccagaagtctgcccagcggagaatttccaggagactgctgggcaacagacaacaagccagaggtcctaatttcagggttcatgttcatgaggtcaaagaactctgtggactgtaggaagccaagagaatgaattcacacatttccgggatgatgtaaatttatcggcttaaaacagttttttctattactcccataaataaacataacagccattgaacgtgctgttgcttactagtattatagaaacattagagataaggctcagtttgatttaagcagaaaagtgaacctggtctccatgcttcttaaagtcttttgcaccttcttgccacaaccctgaagttgaatcatgattaaattcttccttgagatcctgccagtaaaccagacacctgctcagatgcaagtgttgtttctaccttctctaggaaccttctgcctcagttagcagccctgcccctgtgccccgccccgcatcactccccatttccagcctttcctttcctcctggttctttcctctttgtttcccaacagactgagcatcacggtcccgatgctcaggcaatgctatccagattctctccttccttccgctcgtggccgatctcagatgctgccaatttctcacctttggttccttcccccctcaccctcatgctctctggctttcatcctctgtattagaactgccaaatatcacacctgtaatcccagcactttgggaggccaaggtgggttgatcacgaggtcaaaagatcaagaccatcctggccaacatggtgaaaccccgtctctactaaaactacaaaaattagctgggcgtggtggcgtgcgcctgtagtcccacctgctcaggaggctgaggcaggagaatcacttgaacctgggaggcagaggttgcagtaagcccagatcgtgccactgcactccagcctgggtgacagagcgagattctgtctcaaaacaaaacagaacaaaacaaaacaaaaaagaactgccagataaagatcactcttcatggttcagagtttcatcagcctgattccctggaaatggggtcacctcatgacttctggaggcctgaggcacttttgtctttggggacctttcttctgttaaaaaaaatgaaaattatattttataactatttgatataaagataagtatgatcaagtctaaattgtattcatttttaaaaattattattttaaaatacattaaaacgtgtgtgtgtgtgtgtgtgcgcgcgcgtgtgtgtgtgtgtgtgtgcttttggacagggtcttgctctgtcgcccagattgagatcatagctcactgcagcctcgacttcttgggctcaggcaatccattcaccttggcctcccaaagtgctgggattacaggtgtgtgccaccctgcccggcctctcatgggcttttaaagtattgtggctctaggcactgtgcctattgtgcctaaaggaagctaatgaagaagtcaggactgctttgaagggcttggtaaatgcgagtaaaccttcgtaaaaccttttctttctgggaaaccatactactttaaacaaacaaacaaacaaacaaaacattgtatttctgggcatggtggctcacgcctgtaatcccagcactttgggaggccgaggccccagatcgcctgaggtcaggagtttgagaccagcctggccaacatggtgaaaccccatctctactaaaaaatacaaaaattagccaggtgtggtggcaggcgcctgtaatcccagctacttggcgggctgaggcaggagaatcacttgaacccgggaggcggaggttgtagtgagccgagatcgcacccctgcactccagcctgggtgacagagtaacactccatctcaaaaaaaaacaaaattatattccctttgttggaaaaacaatatacttacaaagaaaattttaatgaaaaaagaaccctctcataatcccatatcctaatacaactcttcattttcagttttgtgattcacttccttgtccagatgcaaagctattttcctcttccggatgcaaagctattttcctcttccagatgcaaagctattttatacaattaacagctgttgtgtttgtgcagttttgtattctgttttttccatttaacataattttcttgaaaacattttccatgtttcttttctttttttctttttcttttttttttctgagatggagtctcgctctgtcccccaggctggagtgcagtggcgccatctcggctcactgcaagctcggcctcccgagttcacgccattgtcttgcctcagcctcccaagcagctggagctacaggcgcccgccaccacgcccagctaattttttgcattttcagtagagacggggtttcaccatgttagccaggatggtctcgatctcctgacctcatgatccgctcgcctcagcctcccaaagtgctgggattacaggcgtgagccatggcaactggcctttgtttttttttt

SEQ ID NO: 1621 - DNA, 1964 bp, Homo sapiens
aagttcaactttcttcataccataccatgacgcctgttagcccccttcattcactcaactatccaacatttgaaaagtactttctaggtgccaggtgccaaagatagaatataaatacttatctatagtatcttccatgtgtaaggttttcccttctacccaaaaatcaatacccaggccagtacaatttctaattaaatttttattctatactttttacctggagtagctatttgcattatcatcctcctatgctacaaataatatattaaagtcactgcacagctaaatgtcctttgtttttgaccacagtgttactacattcactccaagcagaggtaagtccatacaatactgctccccaggaagaatgagacacattgggggctccaagcatgatttctaaattaagacacattttaaaaataaggaatggcccaaacttcaaaatcttttaatagtaaattttttattatggaagggaataaaaactatttttaaagaactctaataagaacctcacattttttgatactctaaacttgggaaataaattataaaaggtattattagttttgggacatgttttaacggaaagtggcccagatacagagcttgaacctttcaccagactttgtcactgtctcagaggcagggctcgctgacttgaggtagcaaactgcaaggactgagtcaactagcgttgtttaatccttatctgagggaagctttaagggagccttctccaagcctgatgcctgctcattcacagaaaggctctttcttatgagatataacagcaacctgaatcatcatcctgtttaattagcatctcagagcagcctcagaacaccaaagcaactgggtcacagtagtattatagcacactgatgacaactggttttgttcaagccttgcagattaccctccactactgtgcctaagacggctcttatccagcatggcacacacttctgctcatgctcacaatatttacttactcatgtttgtccatctcccctaaactgtgagacttgttcttgcaccccccaaggactggcacaccataggcactgtaaatgtgggctgatggaatgaatgcaatgtctgacaaacttgagagcctgaagacaactaatgaggatactcttcaatgagttacaaaactgatgctggtggagcttggagaatgtggaacaaggtatgtgttcatttttggccaccagcaaaaagttttttgtccttttaattatgcctcctacatctaggatggaagccgctgtcctcccagctatcaatgccaactacgtggcagctagatgggctacatacaaggagctacccttcaaggccctgtgagcatttctttgatgcaactctgcatcctatcaagcttcttaaagactacttcaaagtgttagccaaagcaatacatacatagccctaggtgttttggtccttacttccttagagctagacgatctccttacgtttcttcatgaaaagctcatgagactggctggagaacctttaacttgccattaacacaaagactgagggaatgggctctggcaccagcctctgggacctgcaccacggcccagtaccaccaaggcttcccagtcaacctcagagggacagagacttgtccagttcttctcaggtccatttactcagtgctactcaagttatggtacatggatttagaatctgcacttatgtcctacagctgctccggcaaaagtgccagtttcagaaactgaatccattaaatacacacttaatcaattatgatgtcagtatgaaacatcagccagccactcactggctaagggctaattgtgtgtacttaagacaaaagttccaggcttgactagctttttagaataaatgtggttggtctaatgtgcatactgtccaggtatgatgcagcacagggctactggagaaaaaaactgagggtg

SEQ ID NO: 1622 - DNA, 1675 bp, Homo sapiens
gttgcagccaacacccaagtcctggggcccctcctgtgaacacccgcttctgctcttctgggggtgtcctcctgaccacggcacctggccaggttcgtgctcctggagtacagacaccaggaggccactgcccggcctgcagacggccccacatctcccctctaaggcgtggaactccctctctgggccaggattgggtacaagagttcttctggaatcagtgaccttgggtgaaacctttcccttctccaagagactgtggtttgccatccggggacgagcccactttccccagacagccctcgcaggtctcagctcctggtcagtccctcccaggacacgaagcatatccacccagccagcctcagacgcccttccaggaggaaaagcagcacccgccctacacaatccatgctggccacggaacttaagcatgtgggtctcaaagttccagaaacacagttggtgccagctccaaccgggacaggcaacagaatgtctttcatctgcacaacctggataacaagacctacatcccacaggtggccgtgacgatgagccaggagatcgccaggcaagtgccaccatgccccacaattggcacacaatgcgcagcagagcctccccctccaccccagagagaaccttttcttccagtcccagcagggtccctcccaccacccctataaaggatgggttcgatgcctcctcctgatagttctggggtcagtttgagtttatagcatgatacaatctcatgcttctttataaaacgtggaaatagatcgttgtaaaaacgtagaatttaattaaatcatcctcagtgccttttaataggaaaataacaaccacatagttcattcaaaaataaatcttcagtttttaataggaacaaagtatctattttgatcagggaaacgaggctgaaaagcaggacacacaactggaaacaggagctcagccagatggccaagttgcatgacttctggggaccctggacacccaggcagcacgccctgcctggagttgtgcagtgggcagcctgcacaactgtatgtggccaccccagctgaggcttctcctccctcttatccaatcatctaacgtgagtgagacccatgactgtacctcaatttctttttgtgcaagataacgatttactattagaacacacgtcctctctgtgttacagggaattgaggatgatatcaacagagatacgtgagtttcccacacgcccttgtctgtaaatccaagggaggcttctaccatgacccctggtattcgaatgcatggatcacctttttcatttttcttttacatcagctgatgaaatcacaaggtctgataagctgtctccttaaagactccacttttggttaagcaacaggtaggcgagtgcattaaaaatcatctgttttctcgctgtgtaacgcggcccactttggaaaacgcgtggaagtgcccattatgggacgcttaaatgtgagatgcgatcccagggaaaggagaacctcccctcactttgtgagccccaccttatctttacaacttataatttacatttttggggctgggcgtgagactactggaggaagggcgtaagtagcatttacactgggaaggctttcatgacattaagctactgtttacaaaactgcagttgctgtaaact

SEQ ID NO: 1623 - DNA, 2019 bp, Homo sapiens
gcaggagcaggcagtgactcctcatgcaacaggctggcctggctttgtttgtctgatgctgggcaggtttccaggagaacacatgatcttttgaggcctaggctcaggcaggcacacgttcatgccatttctaccacattctgtttggtcaaagcaaatcataagtccagcccagatttaaggggtggggaagtagactccacttcctgttgagaggagctgcagctgccaagtgacattgcaaaggagcagggatacaggaaggggaataattgtggctctttttgtagatggtctaccatatggcctaatatatggctttgaatctgagcagtcagactagcaacttgttcttctctgtgagatgaaagatattaaaaagggcagcccatgcaagagactggcgggcactgtttctaccccttcctataaaatattctggacattttttctatgaggaaagggggaactgtcctgaagtctttctgtgcttgcctgctagtcctctccatggcactatctttccacaggccctgcagagaagctcctttcctcatcagcaccaattctaaaataaatcagagtcacttagaagccaagctggaagcacattcaacctgctgggacccaccacccgggagcgaggctcttaaatcaatttggaaattgtttccatgtaatatgaatggacttggtaagggaatagaaatccctgccaaatccctaccttgaataggatgaaaaattagattaatctgaaaaaagcagtcagcaggcagttacttaccctgttttagagatctgggaggactgggaaaattgcggcatggtgtagcagaaagagcaggtctttagagttaaacagactgggctttgcgtcctgggtctgccacttaacagttgtgaactttaagtgcctcatcctgcctgaacctctgtttccttaattccggggtagggatgacaacgcctgccttgctggactgctgggagcattagtgacagcagatgtgaagcatctcacgcagagtggggatggataaacagcggctacaggcacctacctcctggaaaagggctgctgtcatatttgaggcactctcaggcccctgggccagcttttccagggacaaggggcattcccatgggtgttgcacatcgacctttggtctcatgtaaaactcatcttattcatagatacagagtgtacagatatttgggtgacctgctttattttacttaatgccgtaggtattttccacattgccagagcctgcataattaaaatgtgtgatcgttgtgaacagtaagatgtacatgtcaggccatttttttgatatttaggttgtttctggttgtttattggtagagacaatgttacagtggggcaatggagccccccctcctccagtattttaggttatgattattttttatcctatttccagaagtgggatgaagatccccccagttcttgacttatttgtccacattgctcttcagatgtctgtaccattaatactgtcaccaacaacatatgactgcatcgattgttatcaaactcttgccagaattaagaatcacttctcaatatttttaaaggggatataaaatgtggctacattattcttttttagaaagtgtggttcctctgtgatgtgtcagagtggtcggtggactgtacttcccaggattccctctgtgtgtttctgcctcttgtggccacgggaggggttcctgtgtgggcctcagagggcagaagtgaagccacagccctcggccacacacgtgtgttgtcctcagttcctggcctgtctcaggggcgtgaggcagggccgggcctcaaattgcaacttgttcccctggatcctcctacttctaggtagggagtgtgcatttaagtccatgaggaggagctggcttcgaggacacacaacacctcaaggccagatggacaggggtttgtccatcctcgtgggctccgttcatcctggggctccagcctgttcttgctttccc

SEQ ID NO: 1624 - DNA, 2377 bp, Homo sapiens
ctgtctaatacataaatgactagacttggtattcatttttgtgtaacttttgggatgttatgttttccaaggaatttgtacatttcatttaaagtttcagaattttttggcataaagtaattcaaaatatcttattgttcttttaagacctatctaatctgtagttgtgtttcctttttttaaaaattaaaaaaaataatttttaggtaagagatgtagcctcactatgttgccctgacagctttcaaactcctgggctcaagcaatcctccccactcggtctcccaaagtatttcagtttcaggcatgagccaccatgcacagcctgagtctccattttatttgaatattttttattcttgcttatatcatgacatcttccaattgagttttaattctattagtgttgtgaaatgttcctccttattctctagtaatacttcttatttttttctagtaatacttcttatcttaaattccattttgtctaatgatacctataccagctttctattagttaatgtttgtgtggtatatattttcccaatatattttatgcaatctgtgtgtgtatttatctttaacatgtgtctttcttaggtagcatatatttgaattttcctttatcattcagttcgacaattgtactctttatttgaaaaacacagtcccattacatttaatgtaatctgatatatttgaaaatttaactgttaccttatattttctatttgttccatttattctttatttcttatttttacttttcacattcttttctctttattttattttatttctttatttttttgagatggagtcttgctcttgtcaccgaggctggagtgcaatggcatgatcttggcttactgcaacctccgcctcctgggttcaagcgattctcctgccttagcctctggagtagctgggattacgggcacccgccaccacacccgataatttttgtatttttaatagagatggcgtttcgccatgttggccaggctgatctcaaacccctgacctgaggtgatccgcccgcctcggcctcccaaagtgctgggattacaggcgtgagtcaccccctgccggcttttcacattcttttcaacgtgtgacagtgataatcagataatcatcatgtttcctattcttacctctattcgcttttagttatacattccttcttatccttttgttagttacatgggggctcaatgcactagagaggctatcttaaatgtacacttttaccatttccttgtcaatacgaagacctagcatgacttggtctgccaacaaaagtatattcacatatgagaacaattcattacattatcaggcatcttttctcagcttccctgttcctttctgtggtttacagatgaggcttcaggcttgaccaaatctgactggctggctgccggagacactgctacccatcggcccttaataaatggcctcatttgatcatcatgtgatcttcagaagctgggcttgattatccttgccaaacaaaatgctgaaaccaaaaatctgaaaggtatttcttgctaagtaagggagagctgtgcttgtagagtgtggtcaccctgaacagcgcaaactgcttgtggagctccaagactggcagacttgggagggggagcatttagggattggatgactttggccgtggactcggggttgggacagtgaggctgccactgaatggctgtcactcagaaatgtagttactgataaaaagttgactcaatttgtcagggcaggcttaaaatcagttttggtagttactttttgtcatggctgaagagcaatcctctgtcttcttgaatttggacctttatttggacttgagtttggaaaaactaagaaatttttgttctcattttcattacatgcttgagaaaactgaggctcagacaggcgagtaagtttcccagggtcacgcatttaccggctggcatattaaagttttgaacaaagtccacgcttttcttacacactattctcattagtattagttttagtagtaatcgtagctgtacttttggttcataggttcatagagagttgttaatcctactcctcactgataatccattctcgccatcatgccctacaagacctctggttgtttaattccatttctccttcatgctggatcccatctcccatcccctctccacccctccgacagagtcactctttctaatgtctttttatctgtacctaaatatttgtgtagctttgaaaaatctaatttgtcaagggttatgtgttcattttacatttccatacatgttattgtgcaatatatagatctcatttgtttcctaatttttttcactcaccactgttgtgaaaacacactgac

SEQ ID NO: 1625 - DNA, 4145 bp, Homo sapiens
aatcattctactataaagacacttgcacacgtatgtttattgcagcactattgacaatagtgttgcacatgttaactgcctgtaaaggaagctttggcctccccactttggaatgatgtctgatgttcttcaagtctgtgtttcccggggggagtattctcagtctctgtactcaaactctgtacttaatcttattttctgaatctcatgatttaaggctgacatctagaacctggaactgctttcctgtgattcatttcttggtcctaaatgggtctgatacaagtttcgccttaaggaacggtctaggaagttgggtgctggtcattctaattttgactctaggtgcccctgacttggtgaagtgggaaagggaagggacctttctggtgcaccaggcccattcccgaacggggctcctgtggccagcattagccagtgccctccgtctttctcatctggtccagtgacactcacatctggggaatgggctctctcaagttcctcaaggactgctcaggcgggtggtggtcactggagtgatcacggcacattcattgttggacactcttacgtgtatatcccttttaatatccccgataacactatggggacggaccattgtttcttttttgtttgtttttgagataaggtctcactctgtcacccaggctggagtacagtggtgcgatcttggctcactgcagcctccgtctcccaggatcaaggaattctcccacctcagcctcccaagtagctgggattacaggggtgcagcaccatgcccggttaatttttgcatttttagtagagatgaggtttcaccatgttggccaggctcatctcgaactcctgacctcaggtgatccacccgcctcggcctcccaaagtgctgggattacaggtgtgagccaccatgcccaccaccacgccattctaattggcgtgagatggtatctcattgtggtttggatttgcatttctctaatgagcagtggtgatgagctttttttcatatgtttcttggccgtataaatgtccgtttttggagaagtgtctgttcatatcctttgcccacttttttttgtttgtttttttgagacagagtcttgctctgttgcccaggctggagtgcagtggcacaatcttggctcagtgcaacttccgaagcctcccgggttcaagcgattctcctgcctcagcctcctgagtagctgggattacaggcgcacatgtttctatttgtcagataaaaaaactactgctcgagaagacagaaagatgttgattaagaaaacataaagtctgaagtctcagttatgcaggctgatgaagtcgtggggctctaataaacaggatggtggtgttaattaacaaaactgcattgtatacttgacattcgctaaggaagtcgatctcaagtgctccccccaccaacacacacccacaaaaataattacatgaggtgatggccatggtaattagcttgatggtggcagtcacttcacaatgtgtacacacatcaaaacatcacattgcacatcttagaatacatataatttttatttgtcaatcttaactcaagaaagctggggagggaaagaagacggaattagataatgcctccaacattgtctagcacatacatagtcagcgttcagtgacatttcaatgagcaacatcatcgtcttcattgtcatcatcatcttcatcaacctgctgctctgggatgtctgatgaaatttccaaagtaaggttctcgatcacgaaacatgagcttgttcctgcctcttggggaatgactgcagggtgtgtgactctgctggggtggtacacgcccttggtgggtgcgggttcgtggtgcaagctggcagatgccaggtgagacccacccctcgccctcaggtactgagccccacctcggtccttgtgaggtctgccctgaggctggttgcctctgccaagcatttatttttttcatccctaaggaaaactcacactcacctttgctgagaactccatttatttttatctgttatttattctcctgactcatgaaattgcacccttcaggatgccagtacaaaatgttttaaaaaattagtaaaaatgcatgaagtggatgaaagatgttaggcttcttttatcttccaaaatataaatttaaatactttcactttatgatccccagaggaagaattaaataaaaagtaagcacaaaaatttttatcaaactcttactccttccaacttaaatgttaaaagtaaaaacaaaaacagaaagaggaagaccttggcccagcacaggagcgtggttctcaaggcggatgagacgggcccctgacgacccatggagctgagacctcgtgaccttcagtcctcactcggtgcctcccacatgcaggtggcagcacagactgtctgccctggctgtggcactggacgcgaggacggataagcatcagggcttgttggggtcaagaggtggacaacacccccagcccaagcgtccacactaggctctgtccagcgaggatgtgctggccaagcggctgccctcaccgagagaggcagcacaggaagacagcccccatgtaccagagcctgccagggaggcagatgagctcatgtgggtgcccgtggcagcacacagggaagtccgagccagaaggtggaaacaggttcatggaaggccacttagagcagggcctcccagccacctggagccccccaccccaagccccgtgcccagcccaggaccctgcaggcctgaaactggggcgggggtaggtacccagcttctcctgtgggctcattcactaataattcctagaggggccaggggctggcaggctgaggttttgtttcagagcatcaagggaaagaaatgggctggaagagaagcaggagggaaaaagaagctttagatgggaaagcctgggaacaggtcagagaagccaggcccccttcccagggcgaaggcagcgatggagacctcatcagggcgctggttagcccaggagtccctcctctccagaaacagccctcagtgctgccgtggcacacagaggatgggaggatgggagagacgagggtcagggaggccaccaggggacggggctggactccacgagtgacagccatggcgggggcgagccgggcagcctgtcgcagagccacagcttctggggaaggcttccctgagcctggtccctcatttgtgctggtgaaatgtcccattttgctgaagaggagacggacatggaagcctttgtctttagttcacgcttacaagtggcacggggacgtgccgggggatgagtcctggaggggctccgggtggaggcttcccggctgtccctgaattgaagcacaggaaggcggcagggggtcttgggaggtcagaactagaaagtgccttcaagatcttcgtcccaactccctgtcccctagacagaaagcctcagagctgaggagctacgctgactcatccaaggtcaaaagggagctggtggcaaagccgggggaccccttggcttcacaacgtggtcatcacaggccctgatggcatcagggcagttcacccccaaagcgactcgggacacatattgtgacgtagtagggactggggaaggggaagcgagtatggtggctcagatgaagtagttaaaagcagaaaacgggtaactgcagaagtgctggttgtggggggatttacgcttctttttcctccaaagcaccttgtcctggaagtgccaggtgccctctgggaaggccccacttagattgatttctctctctttgggcactttcaaaaggtcctctccaaagcgcaatccatcgactccgccaatctgtcaccaggcagctctgggaacggagccagggacttgcaggtgtggcctcagcaaaaagatgagcagggtggtgcctctgccagggaatcgcctctgccagggaatcgcctccgagagctgagccctaaggcacgctgggccccggcctgatggcgcagagggaggctccccaccctccactccctggctttgtgctttggggccaggcacctgtgtggggtgggcttcccaggacacaaaggctagattcagtgaaagtgattccttggtcagagggagattttcaga

SEQ ID NO: 1626 - DNA, 3995 bp, Homo sapiens
attcaaccctgagaacatatcgagatactattgtatcttttcctttacactgcagctcgtaaaggtgctccttgaaggagatggtaatcgcatttggaggactgcctccctcccagacgctggagaattgtgttgcacaagggctgggggtccactgtggctgaggtggcagcatcagaacacaagtgggaggcaaaggcacccacctgcaccagaacagcaggacatcctcctgtaggaactggagtcacacccatgcaacctttgcaggcagaatgagtgcaaaggtgtctcctcctccaaggatgcctgtgcctggctcttctgagggaaactaaaatcagtcacactctccacccaaaagctgagagcaggtgcaggagaacatgtggcctcagggagccgatggcaaggcaagcccagggctgcacagagcagtggcgcgatcaggattctgacacggggagggagacacctgttccaacgtcgtaatgtaataaatgggtaattgttgctataattaaaatgcttgtaataagagcagacctttatatttgtcaaaacctgaagtacgtttgagtattgccataaaatgtgggaaaataaggaaaacttgattattcattaaaccttagaatgttccaacaccaggataagtaattttaggacaaataaaatcagccatccaacccacaatatttcctatgtgcagaggaagtaaagtgggcaattgggcgaactcaacccgattaaacaattatgcccaaaggcagagatgtctaaatggggcccacccctgccatgaaaagattcttattaatattgtcagcaattttgcttcacaaatatttttgcataaacagagaattaaatggatgaagatctaatggctggcccacaagatgctatgtactgggtgctgatccagcgtatgggagcgagataggaggtgcgtcatggcacggccaggtgagaacagcaacaacctccacagcagagccgtgggccgagcagaaaggctgatattgaacaggaaaggaggccggttccaggcttgagtctaaaacaggagcggtagcacctgcctccagggcaccccaaaagggacttcgcctctgattcgcagctgtggcggcagggcccaggatgacgcactgagtgagcacagggtgtgacctcattgttagacatgggcatgcgcacacagcacgcactatgcaaacacaaatacaccatacacacaacgcacacacaacagaaacactcaagaaccccgttctgtgagcttgggtgtgcgcgcccctgctgctctactctgagggcctgtggcctccgggctccggttcacagcagggtccggctggcggaaactgccccaggcgcatccttccttcttctctcacagccctgggtgcctcctgctgccacatctgggtgagcaggagcgaggccgtctccgcaggaaaaaccagactcctcctcctgggtccaggcctgtggccccagccacatccacaccccacgtggcaagagggagggaggcagtcacaggtggaagccggggccactccttttcatggtgtatttcaaccaaagcatggcgtagccttcgcacggtgttgacctggcacagggagctccgcggaaggaagagcctgcttcacggcccatgtgttgcctgaaggccccggtgcaacgcgtgctcgcccggcacgccaggcctggggtgtgccctgtgcggtgtccaccaccgtctagggagggggccctgcgacagctatcaagcggaagaacgcgctgggacttacaaaagttaggtgatttccccgaagccgcagggctgtgaaactaaacagtgtgaaattgccaattagttaactatttttgtacctaaacaaataatggtttaaaagaatttaaatgagatggtagcagagtcaagactcgggcttccactttctggatatagaatttaattcttttttttttttttttccctgagaacggagtttcgctcttgttgcccaggctggagtgcagtggcgcaatctcggctcactgcaacctccgcctcccgggttcaagcgattctcctgcctcagccttccgagtagctgggattataggcgcccaccaccacgccggggtagtttttgtatttttagtagagtcggggtttcaccgtgttggccaggctggtctcgaacccctgaactcaggtgagcctcccgccttggcctcccaaagtgctgggattacaggtgtgagccactatgcctaattctaaatgagcaagttattatcgcttttgaaaaaattaggatttttaaactttccatctgtccctgagaggccttcggacgcattatgattttggagtctgactacacctctgaagtctccaggagtggggtgaacacacatgttctgaatagagacacagatgctggggtggtaggtaacccagctgaggtccacagatcacggacaggcatgctgggagtggccacagggagaggggagacccaccactcagcagctgtgacttttcatggtttatggaccttgtctccttaaatgtggtgtgcaagagtccgggggcacgatatgttatcccacagacaaatgtgaaactgaggtccaagaccacacacttagcaaggcaagaagctgagatttctatctatgtctgactgccttgaaaagccaacattctccacattgcacacttagcctctcaactctcaagccaggcgccctgaggaacacaaaatgcaccaccaagaatgaagtgaggatccccgcaagcaacaagtgggtgcttctggaagccctggacacagaaagtatccccagccagttctgttcctcaaccccaagtccttagccagctctgaatgcaaatctattatgcgcatttcaccctctttttattttcccacaaatgcagtcttcctttcaaacaactcaatgacaaatgttttcagcaatcattactaaccttattacatctcaataatgccacagacaaaagcagaattcaattgcagtgcagactgaaatgaccttcttgcaaaagagagaagtgatattcccaagtctgacaagcaattttgagtgcactatctgttaatactgtgatcattatttgtttgtgccaccttgggagatggcagccacagccctgggcagagccaagcatgggggaaggtgtctgcagtaagtatccccctggttatttgtaatcattcataaataggcagaggacttctgggtgggaacggggaaggaatcctgacagtcttccccgtctcaaaatctgtagctttggggatgatccgtaaagagtcctgcatgaggtctgcatggagcaaggtccccgaacagcccagtccctgcttcatcccagaccactggccggatgcttctcacttgcagttccctcgatgagcttgaaggagcctgtcgcctggcacacagtgctgagacagggcaatcctgggcatcctcatctggggtgccgctgctttccttgttattccctcagttaacatgtgttgaaagaatgggtcattgtccccttggcatctcagacccaacataaatgctcgattgaaagtccttcggcctttggtgtacagagggtgtgtctcatcgtgcagcacggggagcaagcacactctctgctttccggttccgtgcctgttgatctgaagaaatccacgaagagcacctgcctgcctgcccctcagtaagccgcccctgcctgcctgcccctcagtaaggggcacctgcagagtccaagacaaaagtgctccctgattttccgtgtgtcctcagaatgggaccctactccctgactggaccaaatacatccatcaaatgtaataaagaaaagggatgcagaagtcttccctgtctgagtctcctgcaaaagcaggtgctggtgggaggagcctggcaggagggatggagcagaggacggaggctcaggg

SEQ ID NO: 1627 - DNA, 2121 bp, Homo sapiens
gtgcctgtgtgcggggttaagtggggcagagggtgcctgtcctgcaggggaacaggcaggtccagttaaaagactctgggccttttcctttccccgagggcagagggggtggtcagcagtctgtccccagccttctgcccaccctccagccctcaccaggcccttttcctccctctctgccactgaggggccacagctcagctgtgctctgcaccctgcccctaccagcctcaagggcttgtgtctatatccagagagaagggcgacggcttccttcaattacattcatctgaagtgaagaaaagaaaggaaaaaaaaatacccagtcaccattactcagaatgacaaggctgcttgtgattaagctctgaagatgcgagatcctttattgagagattctttcactgctcagctgcagcacacagcctgggagggggccttgtcacttggggctggtgacagcctccttgaggcagcatccccctccctggcacgctgtgccctcctgccagggcacagagggtttctcatcttggcacttctgacgtttggggctgggccatctgccattttgggcatcctgatgctcagatcatccctgcccccgcctactggatgccagtcacccagcagcacagctgccccaagtcctaacaccaaaaatgtccccaaaccctggcaggtgttgcttggagcaacatccccccatctaaggcgccctccccaccccgggcctcaccccgtcttccggcatcgtgtccctccgtgcctcccttctctgggctgagtctgaccccagcacatacacccctcttttcttccccaggctgtttccccatctgtaaaatgagggtgacgacggacaacttgcgggactaaggtggaggtggactgaggttctgacggccccatctggactgtaaggcgagggtgctttgtaggactctgcccttctcattacgagactttgcacagtggtcctactggatgctggatacacagagaggatggaacgtctccgtcctcaggaatctgaaggccctgaagtggcatcacttgcatggttatgagggtcgtgattgtctcccgatgggctgggaaggacccaatggcaggaaaaggaacactggccactggggagagccctggctagagcaggacggcctgggctgagccgaggttggctgctgtgtctcgggaatctcctgtccttcggtggcgccaggcagtcatgggatgggaccagggcttctgtgagtcccccatgcccatggctcctccagtgctgccacctgaggaccttcctcctgagccgacctccttccgcctctttccagggctcctcctggctgcccgtctgcctggtaatgtcggggctcattttctttgaagatggctgttgggttgcctctttcctgtttatttgtgagctgcagtgtgaaatagctactaattcagatttttactgtggataaacaaatacagaaaattaacagatgtgttttgccgatgtactcagcaaaaataacatccatcgtgatggcaggcatggaggaggacggagccatgaggaggccgagagcccggacccaacatccacagtgcgaaacccgagacatcagagagggtggcagagtgtgatgtggccaggttagcctcctggaccaggaagcagaactggagagggacagagggcaggagcacatggaccccagaagggcagggaggcggagccccgggttggaccaggtggccatgagttcatctggaatccagcatggcagagaccccaggctggaggcccgggaagactccgtagcagaggaagttggaccagagcatgtggatttcaaagtgcatcaggaggccgagggcctgcagatatttggatctcagcaatggaatgggaactagacccctaaaggcaggacaaagcccccggggatgccccagccacagcaaggcaggacggagccctcggggaagtcccagtcatgacaagccaggacagaatccttggagacaccccagccacagctggtttcagtgtctgcatcccaattcaagatgcagagaaacctccaagtttctcttgccacaggaaagggggcgaggagagca

SEQ ID NO: 1628 - DNA, 4228 bp, Homo sapiens
gagaagtggcgcaggctgcccaccctcagacccctgcacacccacactgaggctggggaggaaggagactgtgccagccacccgggcctgagctctgcagacgctgtggctttgcgcatttctcagcactctgcgtttatgacctttccggccagatgtagcatagcaggtgccttcctgtcccttcctatcctccctccactcttccctcttttctcactccttccttccatccttccctcttctcctcactccttccctccatccttccctcctttcctccctccctcctttcctcaggaactttgaggggcccctgagtgccctgcccagggacaggaggtgaaggtgaaggtctggggcttcagatgccagcacttcctctttgacctgcaggggggtcccggagtgaatgggtggcagccacctgggctcccattggagggcggagctccccccaactgcagagctaggttccggagaggggaaaccctgaaggatccctgcaggtgtccaggcagctgatggctggggtctgacaccccttcacccccataccactgttgctgtccttgctgccttcaaaatctctcagccaggaaatgagggtggaatgaggtttgcgcctgcagagccacctctgagcccaaaccctgtgctacatgagacgcaggttgtgtgtgcaaggcctggcctgcatcattccagcttctaaccagcacagcacagtcgcgcaaaggccctaggatacgaggagggagctcccgtctcagggagaccgaaaacctccctggaaatccaagactccttattggagccccaatggtagcatgctagctcccctgctgcttgggttagatgagaaaccaggggcaaaagggcttccttgaagggatggggaagatggcgtgccaggcacatgttccctgggcacagggatggaagttctgagctgtaatctactggggaggatccaagaagagaggaacctggactggaaagaagacaggccactggggtgcagttagggcttgctttattatccctctctgaaccccagcatcctcatacctgaaatgagctaaggatgagagccttcacctagaattgccataggaatgagggcagccatgtgtatggcacaggagggagggagtcactccaggtagctgctgacgatggagatggtggttatggtgacagtggtgatgatgatgatgatgataatgatgacgatgatgatggtggttgtcatgatgtgattagggtgatggtgatgatgacaaggatgaggaagatgatgatgaggatcaggatggtggtggtatttatgatgatggtgatgttggtgatggtgataatgaaggttatgataatgacattgatggtgatggtgacaacaatgataatcatggtggtgatggtggtggtagtatgacggtgataatgactgtgatgttgaggatggtggtggtgatgatggtgatgaagacagtatggtagtgttggtgatgatggtaatggtgatagtgctaatggtgataatgtgatggtgatgattacaattgatgatgatgttggtgatggtgatgatcatggtagtggttatgataatgtgatgatagtaatgacagtgataaaatgatgatggtgatgatgatggtgatgatgatgagatggtagtggtggtgatgttggtgatagtgaggataccggtggtggttatgatgatgatggtgatggtaataattgtcatgatgatggtggtgatgacaatatgatgatggtggtggtggtgatgatgtgtgatggtgaggatgatgatggtgatgatggtcctgttgataggatggtgaggatggtgagcatgatggtgcgacgatgatggtgaagataatggtggcgatggtggtggttaggatgatgtcataatgatggtgatggtgatggtggtgataatggtggtggtggtggtggtgatgatagcgatggtggtggttatgattatgtgatggtgatgatgatagtgatagtagtgatgatggtggtgatgatgatggtgacaataatgatggtgatgataatggcagtggtgatgatgatggcccaggcaagtggatcacctgaggtcaggagttcgagaccagcctggccaacatggtgaaaccccatctctactaaaaatacaaaaattagctgggtgtggtggtgcatcccagctactcaggaggccaagggaagggaatcagttgatgatggtgatggtggtgatggtgataatgatggtggttgtgatggtggtggtggtgatggtgatgatgatgatggtaatggtagtgaaggtgatgatagggagagctgactgagctgagctgggagagaggaagctgaagcacagggttctacccatgatgggagggatgccagtgccatgcagggaggctgacctgagtggggcacattcctcaggtgtcgtcttgaacagaggctcccacctgttcataggagcatcccaggagctgagcaaggatgagtatgtagattgagggtgcctgggggtcagggggaggtcctgcgagcttttctggccctacagcgggtgcctcctggcctcccttccgcagcctcggggtgcagcccgtctgggctctacaggccccgtgcgtggccggggctgtgcgcttacctgcgagagacccttccagcctggccctgcaacaagctccagcactaactgtgcctcctgctctactgaccagcccagagccctgttcctcagacctaagtaatgtggcaatgcttttttttttttttttttttttggcgcgaccaaggctcactctgtcccccaggctggagtgcagtggcatgatctcggctcactgcaacctctgcttcccaggttcaagtgattcccctgcctcggcctcctgagtagctgggatgtaccaccatgcccagctaatttttgtatttttagtagagacggggtttcaccatgttggccaggctggtctcgaactcctgacctcaggtgatcgactagcctgggcctcccaaagtgctgggattacaggcgtgagccaccgtgccctgctgacaacgccttttaagggaaagacccaccctactgttgaccttcattgttctgattacaatgttgcaggactatgaacgcacacaaagctgggagcccttaccaggcggtaaaactggaataaaccaaataaactgaggcctatttaaaagcaaacacaaaacagcgaaaccaataacatttaaagttgcagcacgcgttttgcagggcagatgcttctcggtgacagggcactggcagtgagctccagggtggagagatgtacctgctggctctccgtgtgtatacatttccccgcgttccgttcagtgagctctgctcttacatacttaaggacgtgtcgcatgaaggcgtcttaataatcacgtggctttgtttgttgtcatcacgccttatatttaacccagagctctcctggaaggcacttttatgagcgggttcctgataacttgcctaagatgtctctttcgggtgaagacaagctttgccttgcagcgtgagtaagcggagctttaaacgggaataatccaattattgcagcgactgcgaacagaagaaatgttcattgcatatttactgctgcacttactcctgatgaactgctctgagacggggagagggaaggcgggaagcacacacagtgtggccctgggtgcaccacccacagccccagagagcagctcgcacaccccactgacacattgagctcctgcctcttcttcctgttggaatttacacggggtattgggagtggatgggcctttgctggatgtgatgtctgcatgaatgtgcacgagtacacgcacacaccatatacacacacacacaccccacctcacacacatgggcccctgggacagcatttggaaataagtgtccctccagatcacacttaagactgtgctggatttggtcacagggctgctggatcccgaaacccttctttcatcgaatcagtcaatgttccagaacaagtaactcgtgtcccagacagctgcccctaggaacataggagggggctggggacagcagaggtcgccttccagcttcagggcaggggtgcaaggaaaggagctggaagctagcaggtggggtggggtaggcatcggcctttccacacacactaggccg

SEQ ID NO: 1629 - DNA, 2142 bp, Homo sapiens
actcagagactggggaaggcagcatgtgtgtgtgtttaaagggcgtgattgaggtgtgactggcatatggcacacctcccatggttaaagggtacagtttatgcgctatgacatgcagatatgcccgtgaaaccatcaccaccatcaggatagggaacatatccgtcacccccaaggtttcctcctgccctgatgtgccctcctcctcctcctccctctccctgtattccccacccccgggcaaccactgccttgctgtctgtccctgtacatgagtttgccttttctggagtttatataagtgaaatgacacagtacatacttctttgttgcctggctgccttccctcagcaccgttccccagagatgcggccatgcccttgcctgcaccaaaggttcactccttttcattgctgagtagtattccatcgcatggatgtgctacaatttgcttagctgctgttggtgtacatttatctccaggttaggggtatcgtaaatcaaggcactatcaacatttggatggacatgtgcttttatttttaaaaataagtgagtttggggccaggcgtggtggctcacacctgtaatcccagcattttgggaggctgagtgggggcggatcacctgaggtcaggaattcgagaccagcctggccaacatggtgaaatcccatctctactaaaaatacaaaaatcacctgggcatggcactaggtgcccataatcccagctactcaggaggctgaggcaggagaattgcttgaacccgggaggtggaagttgcagtgagccgaaatcgagccattgcactccagcctgagcaacaagagcaaaactccgtctcaaaaataaataaataaatgagttgggtaaaggtgggcatgtggcccactctcacccgcccacacacgtgcgcagacgggggtggctgcggccgctagggcatgggaggcagcaccccttaccaccagcggaagccccaactttgagagcgagggggtttggggggacgaggtgctgtttatggttttgcagttgctccaggggaaaggcgggctaatgaacagttagtgggaaatagtttattgaagtgaacagaacaagaatacattaaaattattaagactgtggcctggggcagtaagcggcatcctgttttctcatagtttacatgacagtgggagaacacaggaagtggggggaggatgctgggggcaaggagatgcagggaggcctctgccaagggtcaggtggaccagaaacttccctggactcatcctccaaaagttagcatcttctagcagaccctccaacctttgcacctcccaccccatcccattccgtccacagcagtgcctcctagccacttctctttgcttactaacaaaagaaaagggggaaagccttccttcccagctagggcaggatgctgtctcatcacctgtctcagcgggccacgccagtaagcaggaagcggccactgtcgcttctgcagggaaggaatgggcttcccggtgtctccggggcttaatactaaaatcatcatcccccgtctggaaccaggattctcacggccccatctgcattctccttttttgtgccaatagcaggattctcgatattcagctgggcacctcatcgtccaggataaagaccacgcctcccgggctgggtgtgagtctgtgactactctcccaccgatgggatatacacagaagtgacagctccagctcccgggtcacacactgaagggggcatccccccatctctaccgcatgtttgcaatgcggtgaattgtgagccttcttgggccaagcatgtgggccgacacccttaggatggggagtcccgagagagaaggtgctcgagcctccggtgacctcccggggctcagccacctgcctccagatggtcacttctgagaaaattaacttctgatctgtggaagacccatggaagcctggagcctcggtcatgctcagcctcatgtatgtcttaacggaaacaccatttctatctcaattcagcctcgagcctcagaatgaaacaggaagatgcacccagcaaataatacttttggcatgttactaataaaataaggaaaggaaaaacctggggctcagacggtcatctgatttgc

SEQ ID NO: 1630 - DNA, 873 bp, Artificial Sequence
  Mutated murine Hsp68 minimal promoter
gagctccaggaacatccaaactgagcagccggggtcccccccaccccccaccccgccccacgcggcaactttgagcctgtgctgggacagagcctctagttcctaaattagtccatgaggtcagaggcagcactgccattgtaacgcgattggagaggatcacgtcaccggacacgcccccaggcatctccctgggtctcctaaacttggcggggagaagttttagcccttaagttttagcctttaacccccatattcagaactgtgcgagttggcgaaaccccacaaatcacaacaaactgtacacaacaccgagctagaggtgatctttcttgtccattccacacaggccttagtaatgcgtcgccatagcaacagtgtcactagtagcaccagcacttccccacaccctccccctcaggaatccgtactctccagtgaaccccagaaacctctggagagttctggacaagggcggaacccacaactccgattactcaagggaggcggggaagctccaccagacgcgaaactgctggaagattcctggccccaaggcctcctccggctcgctgattggcccagcggagagtgggcggggccggtgaagactccttaaaggcgcagggcggcgagcaggtcaccagacgctgacagctactcagaaccaaatctggttccatccagagacaagcgaagacaagagaagcagagcgagcggcgcgttcccgatcctcggccaggaccagccttccccagagcatccctgccgcggagcgcaaccttcccaggagcatccctgccgcggagcgcaactttccccggagcatccacgccgcggagcgcagccttccagaagcagagcgcggcgcc

SEQ ID NO: 1631 - DNA, 595 bp, Woodchuck hepatitis virus
tcgagaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgca

SEQ ID NO: 1632 - protein, 750 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMTLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 1633 - protein, 819 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 1634 - protein, 789 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRRPSYPDTRSSCSSGDDSVFSPDPMPYEPCLPQYPHINGSVKT

SEQ ID NO: 1635 - protein, 800 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPV

SEQ ID NO: 1636 - protein, 955 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKVSPREALKVKAGTRGLQGGRCRVEKTKQFMLLVVWTELPEQKPRAKHSCFLVPA

SEQ ID NO: 1637 - protein, 798 aa, Homo sapiens
MAWDMCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNDPKGSPFENKTIERTLSVELSGTAGLTPPTTPPHKANQDNPFRASPKLKSSCKTVVPPPSKKPRYSESSGTQGNNSTKKGPEQSELYAQLSKSSVLTGGHEERKTKRPSLRLFGDHDYCQSINSKTEILINISQELQDSRQLENKDVSSDWQGQICSSTDSDQCYLRETLEASKQVSPCSTRKQLQDQEIRAELNKHFGHPSQAVFDDEADKTGELRDSDFSNEQFSKLPMFINSGLAMDGLFDDSEDESDKLSYPWDGTQSYSLFNVSPSCSSFNSPCRDSVSPPKSLFSQRPQRMRSRSRSFSRHRSCSRSPYSRSRSRSPGSRSSSRSCYYYESSHYRHRTHRNSPLYVRSRSRSPYSRRPRYDSYEEYQHERLKREEYRREYEKRESERAKQRERQRQKAIEERRVIYVGKIRPDTTRTELRDRFEVFGEIEECTVNLRDDGDSYGFITYRYTCDAFAALENGYTLRRSNETDFELYFCGRKQFFKSNYADLDSNSDDFDPASTKSKYDSLDFDSLLKEAQRSLRR

SEQ ID NO: 1638 - protein, 852 aa, Homo sapiens
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 1639 - DNA, 210 bp, Mus musculus
atctgagctcttacgcgtgctagcccaagcacccgggcgcggcgagtaggagggggcgccggctatatataccactgctccggagggctgggcgcgcggggactatcccgccaccgttgcgtccctatttgctctcgctacttaggtctgtgcgcagcactcaccgaactcacggcccgcagctcgaactcacgcaagatccaccggtcg

SEQ ID NO: 1640 - DNA, 19 bp, Escherichia coli
tccctatcagtgatagaga

SEQ ID NO: 1641 - DNA, 376 bp, Artificial Sequence
  Full TRE3G promoter
tttactccctatcagtgatagagaacgtatgaagagtttactccctatcagtgatagagaacgtatgcagactttactccctatcagtgatagagaacgtataaggagtttactccctatcagtgatagagaacgtatgaccagtttactccctatcagtgatagagaacgtatctacagtttactccctatcagtgatagagaacgtatatccagtttactccctatcagtgatagagaacgtataagctttaggcgtgtacggtgggcgcctataaaagcagagctcgtttagtgaaccgtcagatcgcctggagcaattccacaacacttttgtcttataccaactttccgtaccacttcctaccctcgtaaa

SEQ ID NO: 1642 - DNA, 134 bp, Artificial Sequence
  TRE3G Minimal Promoter
gtataagctttaggcgtgtacggtgggcgcctataaaagcagagctcgtttagtgaaccgtcagatcgcctggagcaattccacaacacttttgtcttataccaactttccgtaccacttcctaccctcgtaaa

SEQ ID NO: 1643 - DNA, 63 bp, herpes simplex virus
ttcgcatattaaggtgacgcgtgtggcctcgaacaccgagcgaccctgcagcgacccgcttaa

SEQ ID NO: 1644 - DNA, 672 bp, Mus musculus
ttctagagtgtctgaagatagctacagtgtacttacatataataaataaataaatctttaaaaaaaaaaaaaaaaagaaaatgagattgtgcttatttaaaaaaaataaaataaaataaagagatgaaaaaaataataataattttttttttttgccggggtgggagggttaaggaaaagaaaggcaatttatttgcaaaagaggtacatgctatgggcaaaaacttttccacaatggaaaactgaacaaactgttgacgccaggttttttttttttttaagtgggtttctatagcgttgtttaagctcgagattaatttttatgttgtattcatgtgtgtgtttcttgagggtggggggagaggaattttgtaacgtaattaatatgaatgcccagagcaggactgtgtctcacctgtcggtgttacagactatgtaaatagaagaatcttagggctatcagtttcatgttgaaagtgggattccagctagcaaagctattgttgagcccatcctcagctaagaaggccagtgaggagtcagtctgcggatgctttcgctgacgtcatgccaacctttttctcttcgcagaaaggcccgtgagagctgaactctgagcgctgaagttctaagaagccggaccgatgtgcacagagaaggaatgaaggaagt

SEQ ID NO: 1645 - protein, 11 aa, Artificial Sequence
  L807
KEAPPSPPPSP

SEQ ID NO: 1646 - protein, 12 aa, Artificial Sequence
  L807-mts
  MOD_RES (1)..(1)
  MOD_RES (11)..(11): PHOSPHORYLATION
GKEAPPSPPPSP

SEQ ID NO: 1647 - DNA, 97 bp, Simian virus 40
gtaagtttagtctttttgtcttttatttcaggtcccggatccggtggtggtgcaaatcaaagaactgctcctcagtggatgttgcctttacttctag

SEQ ID NO: 1648 - DNA, 506 bp, Homo sapiens
gcggattcgaatcccggccgggaacggtgcattggaacgcggattccccgtgccaagagtgacgtaagtaccgcctatagagtctataggcccacaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaac

SEQ ID NO: 1649 - DNA, 22 bp, Mus musculus
ggacaagtccaaggtgatcaac

SEQ ID NO: 1650 - DNA, 20 bp, Mus musculus
cctggtggtcgaacagctcg

SEQ ID NO: 1651 - DNA, 20 bp, Mus musculus
tggggacggtgatgcggtct

SEQ ID NO: 1652 - DNA, 20 bp, Mus musculus
acgtggcgaagctctgctgc

SEQ ID NO: 1653 - DNA, 19 bp, Mus musculus
gtccggtaacggttctttg

SEQ ID NO: 1654 - DNA, 18 bp, Mus musculus
gctcttgtcaggcaccag

SEQ ID NO: 1655 - DNA, 20 bp, Mus musculus
cttctcgctaaggtggatcg

SEQ ID NO: 1656 - DNA, 20 bp, Mus musculus
caccaagaccagagctgtca

SEQ ID NO: 1657 - DNA, 20 bp, Mus musculus
tggggacggtgatgcggtct

SEQ ID NO: 1658 - DNA, 20 bp, Mus musculus
acgtggcgaagctctgctgc

SEQ ID NO: 1659 - DNA, 20 bp, Mus musculus
accgtcagatcgcctggaga

SEQ ID NO: 1660 - DNA, 22 bp, Mus musculus
tcatcggtggtaccgtctggag

SEQ ID NO: 1661 - DNA, 24 bp, Mus musculus
ctaggccacagaattgaaagatct

SEQ ID NO: 1662 - DNA, 25 bp, Mus musculus
gtaggtggaaattctagcatcatcc

SEQ ID NO: 1663 - DNA, 20 bp, Mus musculus
caaatgttgcttgtctggtg

SEQ ID NO: 1664 - DNA, 20 bp, Mus musculus
gtcagtcgagtgcacagttt

SEQ ID NO: 1665 - DNA, 24 bp, Mus musculus
ctaggccacagaattgaaagatct

SEQ ID NO: 1666 - DNA, 25 bp, Mus musculus
gtaggtggaaattctagcatcatcc

SEQ ID NO: 1667 - DNA, 20 bp, Mus musculus
caaatgttgcttgtctggtg

SEQ ID NO: 1668 - DNA, 20 bp, Mus musculus
gtcagtcgagtgcacagttt

SEQ ID NO: 1669 - DNA, 20 bp, Mus musculus
tcctcaaagatgctcattag

SEQ ID NO: 1670 - DNA, 20 bp, Mus musculus
gtaactcactcatgcaaagt

SEQ ID NO: 1671 - DNA, 24 bp, Mus musculus
cgtctttaattggattacaatgct

SEQ ID NO: 1672 - DNA, 20 bp, Mus musculus
ctagcaagtggttgtggtca

SEQ ID NO: 1673 - DNA, 659 bp, Human cytomegalovirus
acgcgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgtcaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttgcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcc
